US012807652B2

(12) United States Patent
Cai et al.

(10) Patent No.: US 12,807,652 B2
(45) Date of Patent: Nov. 24, 2026

(54) METHOD OF PURIFICATION OF RECOMBINANTLY-PRODUCED RSV PROTEINS IN TRIMERIC FORM

(71) Applicant: Pfizer Inc., New York, NY (US)

(72) Inventors: Ping Cai, Rockville, MD (US); Eun Hee Koh, Washington, DC (US); Jill Ann Paddock, Derry, NH (US); Alexandra Pettaway, Lyman, ME (US); Jeffrey Richard Salm, Wakefield, MA (US); Eugene Joseph Vidunas, Middletown, NY (US); Michele L. Weaver, Chestnut Ridge, NY (US); Xinhao Ye, Media, PA (US); Yonghui Yuan, Blauvelt, NY (US); Jay Zhixing Zhao, Cedar Park, TX (US)

( * ) Notice: Subject to any disclaimer, the term of this patent is extended or adjusted under 35 U.S.C. 154(b) by 412 days.

(21) Appl. No.: 18/031,036

(22) PCT Filed: Jul. 22, 2021

(86) PCT No.: PCT/IB2021/056630
§ 371 (c)(1),
(2) Date: Apr. 10, 2023

(87) PCT Pub. No.: WO2022/023896
PCT Pub. Date: Feb. 3, 2022

(65) Prior Publication Data
US 2024/0025950 A1 Jan. 25, 2024

Related U.S. Application Data

(60) Provisional application No. 63/155,082, filed on Mar. 1, 2021, provisional application No. 63/056,949, filed on Jul. 27, 2020.

(51) Int. Cl.
*C07K 1/00* (2006.01)
*C07K 14/005* (2006.01)
*A61K 38/00* (2006.01)

(52) U.S. Cl.
CPC ............ *C07K 14/005* (2013.01); *A61K 38/00* (2013.01); *C12N 2760/18522* (2013.01); *C12N 2760/18551* (2013.01)

(58) Field of Classification Search
CPC .................... C07K 14/005; C12N 2760/18551
See application file for complete search history.

(56) References Cited

U.S. PATENT DOCUMENTS

2002/0136739 A1* 9/2002 Cates .................... A61K 39/12 435/235.1
2014/0302591 A1* 10/2014 Mitterer .................. C07K 1/18 435/226
2015/0335730 A1 11/2015 Smith et al.
2016/0046675 A1 2/2016 Kwong et al.
2016/0251425 A1 9/2016 Ramasubramanyan et al.
2017/0182151 A1 6/2017 Che et al.
2018/0271970 A1 9/2018 Ciaramella et al.
2019/0330277 A1 10/2019 Chen et al.

FOREIGN PATENT DOCUMENTS

AU 2014100888 A4 9/2014
SG 10201802525 * 4/2018
WO 99/57134 A1 11/1999
WO 2009/079796 A1 7/2009
WO 2011/008974 A2 1/2011
WO 2014/160463 A1 10/2014
WO 2017/053239 A1 3/2017
WO 2017/109629 A1 6/2017
WO 2020/026147 A1 2/2020

OTHER PUBLICATIONS

Fransceus. J Ind Microbiol Biotechnol. May 2017;44(4-5):687-695.*
Sanavia. Computational and Structural Biotechnology Journal, vol. 18, 2020, pp. 1968-1979.*
Krarup A et al, "A highly stable prefusion RSV F vaccine derived from structural analysis of the fusion mechanism", Nature Communications 6:Article No. 8143 (2015).
McLellan et al., "Structure of RSV Fusion Glycoprotein Trimer Bound to a Prefusion-Specific Neutralizing Antibody", Science 340(6136):113-1117 (2013).
PCT International Search Report & Written Opinion for International Application No. PCT/IB2021/056630 mailed on Oct. 22, 2021.
Roder C et al, "Purification of respiratory syncytial virus F and G proteins", Journal of Chromatography B: Biomedical Sciences and Applications 737(1-2):97-106 (2000).
Arnold R, Werner F, Humbert B, Werchau H, König W. Effect of respiratory syncytial virus-antibody complexes on cytokine (IL-8, IL-6, TNF-alpha) release and respiratory burst in human granulocytes. Immunology. Jun. 1994; 82(2):184-91. PMID: 7927487; PMCID: PMC1414821.
Arumugham RG, Hildreth SW, Paradiso PR. Evidence that the fusion protein of respiratory syncytial virus exists as a dimer in its native form. Brief report. Arch Virol. 1989; 106(3-4):327-34. doi: 10.1007/BF01313961. PMID: 2774976.
Chaiwatpongsakorn S, Epand RF, Collins PL, Epand RM, Peeples ME. Soluble respiratory syncytial virus fusion protein in the fully cleaved, pretriggered state is triggered by exposure to low-molarity buffer. J Virol. Apr. 2011;85(8):3968-77. doi: 10.1128/JVI.01813-10. Epub Feb. 9, 2011. PMID: 21307202; PMCID: PMC3126149.

(Continued)

*Primary Examiner* — Yong D Pak

(57) ABSTRACT

The invention relates to a purification method of a recombinantly-produced RSV F protein in trimeric form. According to the invention, the method sequentially comprises an anion exchange chromatography step, a cHA chromatography step and a HIC step. The invention is also directed to a pharmaceutical product including an RSV F protein purified by such a method.

35 Claims, 1 Drawing Sheet

Figure 1:
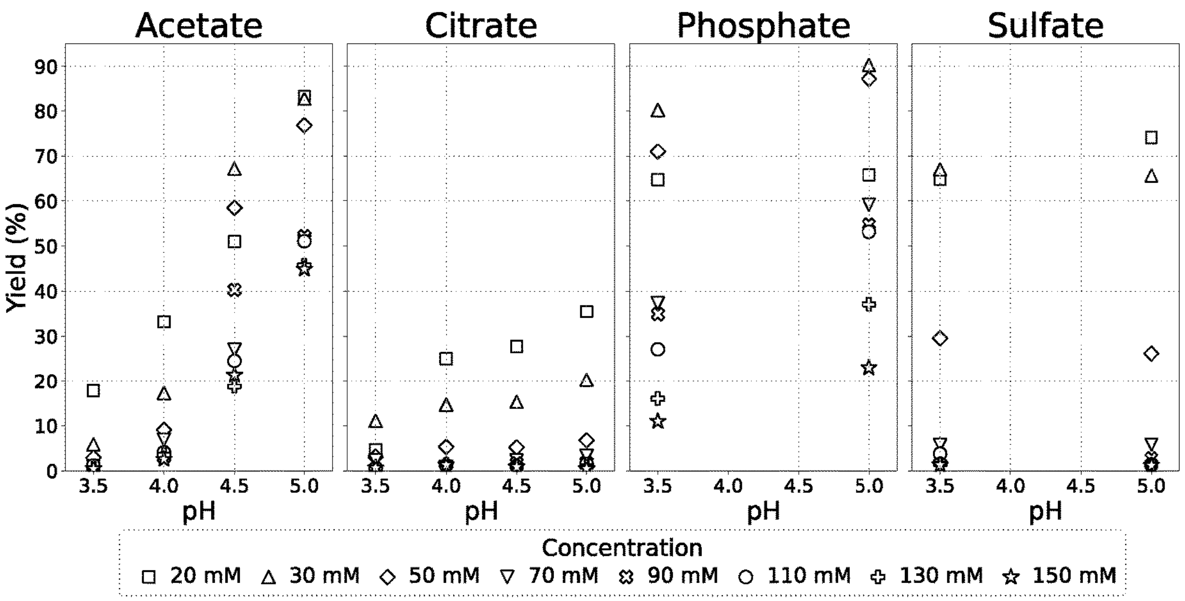

Specification includes a Sequence Listing.

(56) References Cited

OTHER PUBLICATIONS

Downing LA, Bernstein JM, Walter A. Active respiratory syncytial virus purified by ion-exchange chromatography: characterization of binding and elution requirements. J Virol Methods. Aug. 1992; 38(2):215-28. doi: 10.1016/0166-0934 (92)90112-q. PMID: 1517352.

Gilman MSA, Furmanova-Hollenstein P, Pascual G, B van 't Wout A, Langedijk JPM, Mclellan JS. Transient opening of trimeric prefusion RSV F proteins. Nat Commun. May 8, 2019;10(1):2105. doi: 10.1038/s41467-019-09807-5. PMID: 31068578; PMCID: PMC6506550.

Joyce MG, Zhang B, Ou L, Chen M, Chuang GY, Druz A, Kong WP, Lai YT, Rundlet EJ, Tsybovsky Y, Yang Y, Georgiev IS, Guttman M, Lees CR, Pancera M, Sastry M, Soto C, Stewart-Jones GBE, Thomas PV, Van Galen JG, Baxa U, Lee KK, Mascola JR, Graham BS, Kwong PD. Iterative structure-based improvement of a fusion-glycoprotein vaccine against RSV. Nat Struct Mol Biol. Sep. 2016;23(9): 811-820. doi: 10.1038/nsmb.3267. Epub Aug. 1, 2016. PMID: 27478931; PMCID: PMC5016229.

López JA, Bustos R, Orvell C, Berois M, Arbiza J, García-Barreno B, Melero JA. Antigenic structure of human respiratory syncytial virus fusion glycoprotein. J Virol. Aug. 1998; 72(8):6922-8. doi: 10.1128/JVI.72.8.6922-6928.1998. PMID: 9658147; PMCID: PMC109907.

McLellan JS, Chen M, Joyce MG, Sastry M, Stewart-Jones GB, Yang Y, Zhang B, Chen L, Srivatsan S, Zheng A, Zhou T, Graepel KW, Kumar A, Moin S, Boyington JC, Chuang GY, Soto C, Baxa U, Bakker AQ, Spits H, Beaumont T, Zheng Z, Xia N, Ko SY, Todd JP, Rao S, Graham BS, Kwong PD. Structure-based design of a fusion glycoprotein vaccine for respiratory syncytial virus. Science. Nov. 1, 2013;342(6158):592-8. doi: 10.1126/science.1243283. Erratum in: Science. Nov. 22, 2013;342(6161):931. PMID: 24179220; PMCID: PMC4461862.

Schröder E, Jönsson T, Poole L. Hydroxyapatite chromatography: altering the phosphate-dependent elution profile of protein as a function of pH. Anal Biochem. Feb. 1, 2003;313(1):176-8. doi: 10.1016/s0003-2697(02)00567-5. PMID: 12576076.

Stewart-Jones GB, Thomas PV, Chen M, Druz A, Joyce MG, Kong WP, Sastry M, Soto C, Yang Y, Zhang B, Chen L, Chuang GY, Georgiev IS, Mclellan JS, Srivatsan S, Zhou T, Baxa U, Mascola JR, Graham BS, Kwong Pd. A Cysteine Zipper Stabilizes a Pre-Fusion F Glycoprotein Vaccine for Respiratory Syncytial Virus. PLoS One. Jun. 22, 2015;10(6):e0128779. doi: 10.1371/journal.pone.0128779. PMID: 26098893; PMCID: PMC4476739.

Written Opinion of the Int'l. Search Authority in PCT/IB2021/056629.

Zheng Y, Tang Y, Fu Y, He J, Wang X, Hong T. Purification of human respiratory syncytial virus fusion glycoprotein. Protein Expr Purif. Jan. 2012;81(1):115-118. doi: 10.1016/j.pep.2011.09.011. Epub Sep. 29, 2011. PMID: 21979254.

Harshbarger W, Abeyrathne PD, Tian S, Huang Y, Chandramouli S, Bottomley MJ, Malito E. Improved epitope resolution of the prefusion trimer-specific antibody AM14 bound to the RSV F glycoprotein. MAbs. Jan.-Dec. 2021;13(1):1955812. doi: 10.1080/19420862.2021.1955812. PMID: 34420474; PMCID: PMC8386734.

McLellan JS, Chen M, Leung S, Graepel KW, Du X, Yang Y, Zhou T, Baxa U, Yasuda E, Beaumont T, Kumar A, Modjarrad K, Zheng Z, Zhao M, Xia N, Kwong PD, Graham BS. Structure of RSV fusion glycoprotein trimer bound to a prefusion-specific neutralizing antibody. Science. May 3, 20131;340(6136): 1113-7. doi: 10.1126/science. 1234914. Epub Apr. 25, 2013. PMID: 23618766; PMCID: PMC4459498. Supplementary Materials.

Gilman MS, Moin SM, Mas V, Chen M, Patel NK, Kramer K, Zhu Q, Kabeche SC, Kumar A, Palomo C, Beaumont T, Baxa U, Ulbrandt ND, Melero JA, Graham BS, McLellan JS. Characterization of a Prefusion-Specific Antibody That Recognizes a Quaternary, Cleavage-Dependent Epitope on the RSV Fusion Glycoprotein. PLoS Pathog. Jul. 10, 2015;11(7):e1005035. doi: 10.1371/journal.ppat. 1005035. PMID: 26161532; PMCID: PMC4498696.

Selective removal of aggregates with Capto™ adhere, Application note 28-9078-93 AB, GE Healthcare Life Sciences (Cytiva) Aug. 2012.

* cited by examiner

METHOD OF PURIFICATION OF RECOMBINANTLY-PRODUCED RSV PROTEINS IN TRIMERIC FORM

REFERENCE TO RELATED APPLICATIONS

This application is a 35 USC § 371 national stage application of PCT International Application No. PCT/IB2021/056630 filed Jul. 22, 2021, which claims benefit of U.S. Provisional Application No. 63/155,082 filed on Mar. 1, 2021, and U.S. Provisional Application No. 63/056,949 filed on Jul. 27, 2020, all of which are hereby incorporated by referenced in their entireties.

REFERENCE TO SEQUENCE LISTING

This application is being filed electronically via EFS-Web and includes an electronically submitted sequence listing in .txt format. The .txt file contains a sequence listing entitled "PC072651A_SeqListing_ST25.txt" created on Jul. 1, 2021 and having a size of 1,275 KB. The sequence listing contained in this .txt file is part of the specification and is herein incorporated by reference in its entirety.

TECHNICAL FIELD

The present invention relates to processes of manufacturing respiratory syncytial virus (RSV) vaccines and more specifically to methods of purification of recombinantly-produced RSV F proteins in trimeric form.

BACKGROUND OF THE INVENTION

Recombinant proteins such as those used for therapeutic or prophylactic purposes, are produced in genetically engineered host cells, harvested from bioreactors and then purified under controlled multi-step processes designed to confer a high degree of purity to the final product.

The cell culture methods used for the production of such RSV F proteins known from WO 2017/109629, typically produce

- proteins of interest in a trimeric form and in a reactive form, meaning that they bind prefusion specific antibodies and elicit high levels of neutralizing antibodies. In this form, the proteins adopt a globular prefusion conformation;
- proteins in a trimeric form but non-reactive, meaning that they do not bind prefusion specific antibodies and do not elicit high levels of neutralizing antibodies. In this form, the proteins adopt an elongated conformation, but not a prefusion conformation;
- partially processed proteins corresponding to protomers missing glycosylation of an amino-acid or including incomplete cleavage at the protease (e.g. trypsin) site.

A purification method suitable for such RSV protein would typically include an initial clarification of the cell culture fluid from the bioreactor and, subsequently, a first ultra-filtration step. The product would then be subjected sequentially to a plurality of chromatography steps and then to a virus filtration step and a second ultra-filtration step.

For the chromatography steps, various technologies are available. Sequences of chromatography steps that were found to be suitable for such proteins typically consisted of a cation exchange (CEX) chromatography step, a carbonate-containing hydroxyapatite (cHA) chromatography step and an anion exchange (AEX) chromatography step.

Those sequences were in particular suitable for minimizing the level of residual host cell proteins (HCPs), that are proteins expressed by the host cells used for the production of the therapeutic protein. From a regulatory standpoint, there may not be any defined acceptable level of HCP for all the biopharmaceutical products, but it is required, on a case-by-case basis, to minimize the level of HCP in order to minimize any associated safety risk and negative effect on efficacy.

However, purifications methods involving such chromatography steps were found to be associated with a low overall product yield (of less than 10%) and poorly efficient for reducing the non-reactive trimeric proteins.

There was therefore a need for an improved purification method with a higher yield and a higher efficacy in terms of reducing the level of non-reactive species, with no negative impact on the elimination of HCPs and other impurities.

SUMMARY OF THE INVENTION

The inventors have found in particular that the cation exchange chromatography step caused a significant fraction of reactive trimers (RT) to be converted into non-reactive trimers (NRT). This therefore affected the overall product yield.

A purification method is described below that addresses the aforementioned problem.

According to a first aspect of the present invention, the method of purification of a recombinantly-produced RSV F protein in trimeric form, sequentially comprises (a) an anion exchange chromatography step, (b) a cHA chromatography step and (c) a Hydrophobic Interaction Chromatography (HIC) step.

With the method thus defined, which does not involve any cation exchange chromatography, the overall product yield is increased from 5-10% to 20%-40% and the elimination of non-reactive trimer species is enhanced. The stability and bioactivity of the proteins purified with the method of the invention are not negatively affected as compared to known methods.

According to preferred embodiments of the invention:

- the anion exchange chromatography step is run in a bind and elute mode and comprises
- (a.1) contacting a load solution comprising the RSV F protein with an anion exchange chromatography medium, whereby the RSV F protein binds to the anion exchange chromatography medium;
- (a.2) washing the anion exchange chromatography medium with at least one lower pH wash solution at a pH between 3.0 and 6.5; and
- (a.3) eluting the RSV F protein from the anion exchange chromatography medium, thereby obtaining an anion exchange elution pool;
- the pH of the load solution is between 7.0 and 8.5, preferably at about 7.5;
- the pH of said lower pH wash solution is between 4.0 and 6.0, preferably between 4.5 and 5.5, preferably at about 5.0;
- said lower pH wash solution comprises acetate at a concentration between 56 and 84 mM, preferably between 63 and 77 mM, preferably at about 70 mM;
- prior to washing the anion exchange chromatography medium with the lower pH wash solution, the anion exchange chromatography medium is washed with at least a first higher pH wash solution at a pH between 7.0 and 8.0, preferably at about 7.5;

said first higher pH wash solution comprises Tris at a concentration between 18 and 22 mM, preferably at about 20 mM;
said first higher pH wash solution comprises NaCl at a concentration between 45 and 55 mM, preferably at about 50 mM;
after washing the anion exchange chromatography medium with the lower pH wash solution and prior to eluting the RSV F protein, the anion exchange chromatography medium is further washed with at least a second higher pH wash solution at a pH between 7.0 and 8.0, preferably at about 7.5;
said second higher pH wash solution comprises Tris at a concentration between and 55 mM, preferably at about 50 mM;
said second higher pH wash solution comprises NaCl at a concentration between 18 and 22 mM, preferably at about 20 mM;
the RSV F protein is eluted with an elution solution having a pH between 7.0 and 8.0, preferably at about 7.5;
said elution solution comprises NaCl at a concentration between 146 and 180 mM, preferably at about 163 mM;
said elution solution comprises Tris at a concentration between 18 and 22 mM, preferably at about 20 mM;
the cHA chromatography step is run in a flow-through mode and comprises
(b.1) adding phosphate to the anion exchange elution pool, thereby obtaining a conditioned cHA load solution;
(b.2) contacting said conditioned cHA load solution, comprising the RSV F protein and impurities, with a cHA medium, whereby impurities bind to the medium while the RSV F protein flows through the medium;
(b.3) washing the cHA chromatography medium with a cHA wash solution at a pH between 6.0 and 8.0, preferably at about 7.0; and
(b.4) collecting the RSV F protein in a flow-through pool;
the cHA wash solution comprises Tris at a concentration of about 20 mM, NaCl at a concentration of about 100 mM and sodium phosphate at a concentration of about 13 mM;
the HIC step is run in a bind and elute mode and comprises
(c.1) adding phosphate to the flow-through pool from the cHA chromatography step, thereby obtaining a conditioned HIC load solution;
(c.2) contacting said conditioned HIC load solution, comprising the RSV F protein, with a HIC medium, whereby the RSV F protein binds to the HIC medium;
(c.3) washing the HIC medium with a HIC wash solution at a pH between 6.0 and 8.0, preferably at about 7.0; and
(c.4) eluting the RSV F protein from the HIC medium with a HIC elution solution at a pH between 6.0 and 8.0, preferably at about 7.0;
the HIC wash solution comprises potassium phosphate at a concentration of about 1.1 M;
the HIC elution solution comprises potassium phosphate at a concentration of about 448 mM;
the RSV F protein is a protein from RSV subgroup A;
the RSV F protein is a protein from RSV subgroup B;
the RSV F protein is in a prefusion conformation;
the RSV F protein is a mutant of a wild-type F protein for any RSV subgroup that contains one or more introduced mutations;
the RSV F mutant is stabilized in prefusion conformation;
the RSV F mutant specifically binds to antibody D25 or AM14;
the RSV F protein is formulated for use as an injectable pharmaceutical product;

In a further aspect of the invention, it is provided a pharmaceutical product including an RSV protein purified by a method according to the first aspect of the invention.

In an embodiment, the recombinantly-produced RSV protein purified according to the method of the invention is an RSV F protein.

In an embodiment, the recombinantly-produced RSV protein purified according to the method of the invention is an RSV F protein from RSV subgroup A.

In an embodiment, the recombinantly-produced RSV protein purified according to the method of the invention is an RSV F protein from RSV subgroup B.

In an embodiment, the recombinantly-produced RSV protein purified according to the method of the invention is an RSV F protein in prefusion conformation.

In an embodiment, the recombinantly-produced RSV protein purified according to the method of the invention is an RSV F mutant protein.

In an embodiment, the recombinantly-produced RSV protein purified according to the method of the invention is an RSV F mutant protein stabilized in prefusion conformation.

In an embodiment, the recombinantly-produced RSV protein purified according to the method of the invention is an RSV F mutant protein in trimeric form.

In a preferred embodiment, the recombinantly-produced RSV protein purified according to the method of the invention is an RSV F mutant protein in trimeric form and stabilized in prefusion conformation.

In a most preferred embodiment, the recombinantly-produced RSV protein purified according to the method of the invention is an RSV F mutant protein in trimeric form comprising a trimerization domain linked to the C-terminus of F1 polypeptide of said F mutant protein and stabilized in prefusion conformation.

In a particular embodiment, said trimerization domain is a T4 fibritin foldon domain.

In a particular embodiment, said T4 fibritin foldon domain has the amino acid sequence GYIPEAPRDGQAYVRKDGEWVLLSTFL (SEQ ID NO: 40).

In a preferred embodiment, the recombinantly-produced RSV protein purified according to the method of the invention is an RSV F mutant which specifically binds to antibody D25 and/or AM14.

Preferably the recombinantly-produced RSV protein purified according to the method of the invention is an RSV F mutant which specifically binds to antibody D25 and AM14.

The amino acid sequence of a large number of native RSV F proteins from different RSV subtypes, as well as nucleic acid sequences encoding such proteins, is known in the art. For example, the sequence of several subtype A, B, and bovine RSV F0 precursor proteins are set forth in WO 2017/109629, SEQ ID NOs: 1, 2, 4, 6 and 81-270, which are set forth in the Sequence Listing submitted herewith. Any reference to SEQ ID NOs in the specification is to those in WO 2017/109629, which are included in the Sequence Listing contained in the .txt file submitted as part of this specification and which Sequence Listing is herein incorporated by reference in its entirety.

The native RSV F protein exhibits remarkable sequence conservation across RSV subtypes. For example, RSV subtypes A and B share 90% sequence identity, and RSV subtypes A and B each share 81% sequence identify with bovine RSV F protein, across the F0 precursor molecule. Within RSV subtypes the F0 sequence identity is even greater; for example, within each of RSV A, B, and bovine subtypes, the RSV F0 precursor protein has about 98% sequence identity. Nearly all identified RSV F0 precursor sequences consist of 574 amino acids in length, with minor differences in length typically due to the length of the C-terminal cytoplasmic tail. Sequence identity across various native RSV F proteins is known in the art (see, for example, WO 2014/160463). To further illustrate the level of the sequence conservation of F proteins, non-consensus amino acid residues among F0 precursor polypeptide sequences from representative RSV A strains and RSV B strains are provided in Tables 17 and 18 of WO 2014/160463, respectively (where non-consensus amino acids were identified following alignment of selected F protein sequences from RSV A strains with ClustalX (v. 2)).

In some specific embodiments, the recombinantly-produced RSV protein purified according to the method of the invention is an RSV F mutant comprising a pair of cystine mutations, termed "engineered disulfide bond mutation" in WO 2017/109629, wherein the mutant comprises the same introduced mutations that are in any of the exemplary mutants provided in Tables 1 and 4-6 of WO 2017/109629. The exemplary RSV F mutants provided in Tables 1 and 4-6 of WO 2017/109629 are based on the same native F0 sequence of RSV A2 strain with three naturally occurring substitutions at positions 102, 379, and 447 (SEQ ID NO:3). The same introduced mutations in each of the mutants can be made to a native F0 polypeptide sequence of any other RSV subtype or strain to arrive at different RSV F mutants, such as a native F0 polypeptide sequence set forth in any of the SEQ ID NOs: 1, 2, 4, 6, and 81-270. RSV F mutants that are based on a native F0 polypeptide sequence of any other RSV subtype or strain and comprise any of the engineered disulfide mutations are also within the scope of the invention. In some particular embodiments, the recombinantly-produced RSV protein purified according to the method of the invention is an RSV F protein mutant comprising at least one engineered disulfide mutation selected from the group consisting of: 55C and 188C; 155C and 290C; 103C and 148C; and 142C and 371C, such as S55C and L188C, S155C and S290C, T103C and I148C, or L142C and N371C.

In other embodiments, the recombinantly-produced RSV protein purified according to the method of the invention is an RSV F mutant that comprise one or more cavity filling mutations. The term "cavity filling mutation" refers to the substitution of an amino acid residue in the wild-type RSV F protein by an amino acid that is expected to fill an internal cavity of the mature RSV F protein. In one application, such cavity-filling mutations contribute to stabilizing the pre-fusion conformation of a RSV F protein mutant. The cavities in the pre-fusion conformation of the RSV F protein can be identified by methods known in the art, such as by visual inspection of a crystal structure of RSV F in a pre-fusion conformation, or by using computational protein design software (such as BioLuminate™ [BioLuminate, Schrodinger LLC, New York, 2015], Discovery Studio™ [Discovery Studio Modeling Environment, Accelrys, San Diego, 2015], MOE™ [Molecular Operating Environment, Chemical Computing Group Inc., Montreal, 2015], and Rosetta™ [Rosetta, University of Washington, Seattle,) 2015]). The amino acids to be replaced for cavity-filling mutations typically include small aliphatic (e.g. Gly, Ala, and Val) or small polar amino acids (e.g. Ser and Thr). They may also include amino acids that are buried in the pre-fusion conformation but exposed to solvent in the post-conformation. The replacement amino acids can be large aliphatic amino acids (Ile, Leu and Met) or large aromatic amino acids (His, Phe, Tyr and Trp). For example, in several embodiments, the RSV F protein mutant includes a T54H mutation.

In some specific embodiments, the recombinantly-produced RSV protein purified according to the method of the invention is an RSV F protein mutant comprising one or more cavity filling mutations selected from the group consisting of:

1) substitution of S at positions 55, 62, 155, 190, or 290 with I, Y, L, H, or M;
2) substitution of T at position 54, 58, 189, 219, or 397 with I, Y, L, H, or M;
3) substitution of G at position 151 with A or H;
4) substitution of A at position 147 or 298 with I, L, H, or M;
5) substitution of V at position 164, 187, 192, 207, 220, 296, 300, or 495 with I, Y, H; and
6) substitution of R at position 106 with W.

In some specific embodiments, the recombinantly-produced RSV protein purified according to the method of the invention is an RSV F mutant comprising one or more cavity filling mutations, wherein the mutant comprises the cavity filling mutations in any of the mutants provided in Tables 2, 4, and 6 of WO 2017/109629. RSV F mutants provided in those Tables 2, 4, and 6 are based on the same native F0 sequence of RSV A2 strain with three naturally occurring substitutions at positions 102, 379, and 447 (SEQ ID NO:3). The same introduced mutations in each of the mutants can be made to a native F0 polypeptide sequence of any other RSV subtype or strain to arrive at different RSV F mutants, such as a native F0 polypeptide sequence set forth in any of the SEQ ID NOs:1, 2, 4, 6, and 81-270. The RSV F mutants that are based on a native F0 polypeptide sequence of any other RSV subtype or strain and comprise any of the one or more cavity filling mutations are also within the scope of the invention. In some particular embodiments, the recombinantly-produced RSV protein purified according to the method of the invention is an RSV F protein mutant comprising at least one cavity filling mutation selected from the group consisting of: T54H, S190I, and V296I.

In still other embodiments, the recombinantly-produced RSV protein purified according to the method of the invention is an RSV F protein mutant including one or more electrostatic mutations. The term "electrostatic mutation" refers to an amino acid mutation introduced to a wild-type RSV F protein that decreases ionic repulsion or increase ionic attraction between residues in a protein that are proximate to each other in the folded structure. As hydrogen bonding is a special case of ionic attraction, electrostatic mutations may increase hydrogen bonding between such proximate residues. In one example, an electrostatic mutation may be introduced to improve trimer stability. In some embodiments, an electrostatic mutation is introduced to decrease repulsive ionic interactions or increase attractive ionic interactions (potentially including hydrogen bonds) between residues that are in close proximity in the RSV F glycoprotein in its pre-fusion conformation but not in its post-fusion conformation. For example, in the pre-fusion conformation, the acidic side chain of Asp486 from one protomer of the RSV F glycoprotein trimer is located at the trimer interface and structurally sandwiched between two other acidic side chains of Glu487 and Asp489 from another protomer. On the other hand, in the post-fusion conformation, the acidic side chain of Asp486 is located on the trimer surface and exposed to solvent. In several embodiments, the RSV F protein mutant includes an electrostatic D486S substitution that reduces repulsive ionic interactions or increases attractive ionic interactions with acidic residues of Glu487 and Asp489 from another protomer of RSV F trimer. Therefore, in an embodiment, the recombinantly-produced RSV protein purified according to the method of the invention comprises an electrostatic D486S substitution. Typically, introduction of an electrostatic mutation will increase the melting temperature (Tm) of the pre-fusion conformation or pre-fusion trimer conformation of the RSV F protein.

Unfavorable electrostatic interactions in a pre-fusion or pre-fusion trimer conformation can be identified by method known in the art, such as by visual inspection of a crystal structure of RSV F in a pre-fusion or pre-fusion trimer conformation, or by using computational protein design software (such as BioLuminate™ [BioLuminate, Schrodinger LLC, New York, 2015], Discovery Studio™ [Discovery Studio Modeling Environment, Accelrys, San Diego, 2015], MOE™ [Molecular Operating Environment, Chemical Computing Group Inc., Montreal, 2015.], and Rosetta™ [Rosetta, University of Washington, Seattle, 2015.]).

In some specific embodiments, the recombinantly-produced RSV protein purified according to the method of the invention is an RSV F protein mutant comprising at least one electrostatic mutation selected from the group consisting of:

1) substitution of E at position 82, 92, or 487 by D, F, Q, T, S, L, or H;
2) substitution of K at position 315, 394, or 399 by F, M, R, S, L, I, Q, or T;
3) substitution of D at position 392, 486, or 489 by H, S, N, T, or P; and
4) substitution of R at position 106 or 339 by F, Q, N, or W.

In some specific embodiments, the recombinantly-produced RSV protein purified according to the method of the invention is an RSV F mutant comprising one or more electrostatic mutations, wherein the mutant comprises the electrostatic mutations in any of the mutants provided in Tables 3, 5, and 6 of WO 2017/109629. RSV F mutants provided in those Tables 3, 5, and 6 are based on the same native F0 sequence of RSV A2 strain with three naturally occurring substitutions at positions 102, 379, and 447 (SEQ ID NO:3). The same introduced mutations in each of the mutants can be made to a native F0 polypeptide sequence of any other RSV subtype or strain to arrive at different RSV F mutants, such as a native F0 polypeptide sequence set forth in any of the SEQ ID NOs:1, 2, 4, 6, and 81-270. RSV F mutants that are based on a native F0 polypeptide sequence of any other RSV subtype or strain and comprise any of the one or more electrostatic mutations are also within the scope of the invention. In some particular embodiments, the recombinantly-produced RSV protein purified according to the method of the invention is an RSV F protein mutant comprising mutation D486S. B-2 (d) Combination of Engineered Disulfide Bond Mutations, Cavity Filling Mutations, and Electrostatic Mutations.

In another aspect, the recombinantly-produced RSV protein purified according to the method of the invention is an RSV F protein mutant comprising a combination of two or more different types of mutations selected from engineered disulfide bond mutations, cavity filling mutations, and electrostatic mutations, each as described herein above. In some embodiments, the mutants comprise at least one engineered disulfide bond mutation and at least one cavity filling mutation. In some specific embodiments, the RSV F mutants include a combination of mutations as noted in Table 4 of WO 2017/109629.

In some further embodiments, the recombinantly-produced RSV protein purified according to the method of the invention is an RSV F protein mutant comprising at least one engineered disulfide mutation and at least one electrostatic mutation. In some specific embodiments, the RSV F mutants include a combination of mutations as noted in Table 5 of WO 2017/109629.

In still other embodiments, the recombinantly-produced RSV protein purified according to the method of the invention is an RSV F protein mutant comprising at least one engineered disulfide mutation, at least one cavity filling mutation, and at least one electrostatic mutation. In some specific embodiments, the RSV F mutants include a combination of mutations as provided in Table 6 of WO 2017/109629.

In some particular embodiments, the recombinantly-produced RSV protein purified according to the method of the invention is an RSV F mutant that comprises a combination of mutations selected from the group consisting of:

(1) combination of T103C, I148C, S190I, and D486S;
(2) combination of T54H S55C L188C D486S;
(3) combination of T54H, T103C, I148C, S190I, V296I, and D486S;
(4) combination of T54H, S55C, L142C, L188C, V296I, and N371C;
(5) combination of S55C, L188C, and D486S;
(6) combination of T54H, S55C, L188C, and S190I;
(7) combination of S55C, L188C, S190I, and D486S;
(8) combination of T54H, S55C, L188C, S190I, and D486S;
(9) combination of S155C, S190I, S290C, and D486S;
(10) combination of T54H, S55C, L142C, L188C, V296I, N371C, D486S, E487Q, and D489S; and
(11) combination of T54H, S155C, S190I, S290C, and V296I.

In some specific embodiments, the RSV F mutant comprises a combination of introduced mutations, wherein the mutant comprises a combination of mutations in any of the mutants provided in Tables 4, 5, and 6 of WO 2017/109629. RSV F mutants provided in those Tables 4, 5, and 6 are based on the same native F0 sequence of RSV A2 strain with three naturally occurring substitutions at positions 102, 379, and 447 (SEQ ID NO:3). The same introduced mutations in each of the mutants can be made to a native F0 polypeptide sequence of any other RSV subtype or strain to arrive at different RSV F mutants, such as a native F0 polypeptide sequence set forth in any of the SEQ ID NOs:1, 2, 4, 6, and 81-270. RSV F mutants that are based on a native F0 polypeptide sequence of any other RSV subtype or strain and comprise any of the combination of mutations are also within the scope of the invention.

In some other particular embodiments, the recombinantly-produced RSV protein purified according to the method of the invention is an RSV F mutant comprising a cysteine (C) at position 103 (103C) and at position 148 (148C), an isoleucine (I) at position 190 (190I), and a serine (S) at position 486 (486S), and wherein the mutant comprises a F1 polypeptide and a F2 polypeptide selected from the group consisting of:

(1) a F2 polypeptide comprising the amino acid sequence of SEQ ID NO:41 and a F1 polypeptide comprising the amino acid sequence of SEQ ID NO:42;

(2) a F2 polypeptide comprising an amino acid sequence that is at least 97%, 98% or 99% identical to the amino acid sequence of SEQ ID NO:41 and a F1 polypeptide comprising an amino acid sequence that is at least 97%, 98%, or 99% identical to the amino acid sequence of SEQ ID NO:42;

(3) a F2 polypeptide comprising the amino acid sequence of SEQ ID NO: 43 and a F1 polypeptide comprising the amino acid sequence of SEQ ID NO:44;

(4) a F2 polypeptide comprising an amino acid sequence that is at least 97%, 98% or 99% identical to the amino acid sequence of SEQ ID NO:43 and a F1 polypeptide comprising an amino acid sequence that is at least 97%, 98%, or 99% identical to the amino acid sequence of SEQ ID NO:44;

(5) a F2 polypeptide comprising the amino acid sequence of SEQ ID NO: 45 and a

F1 polypeptide comprising the amino acid sequence of SEQ ID NO:46;

(6) a F2 polypeptide comprising an amino acid sequence that is at least 97%, 98% or 99% identical to the amino acid sequence of SEQ ID NO:45 and a F1 polypeptide comprising an amino acid sequence that is at least 97%, 98%, or 99% identical to the amino acid sequence of SEQ ID NO:46;

(7) a F2 polypeptide comprising the amino acid sequence of SEQ ID NO: 47 and a F1 polypeptide comprising the amino acid sequence of SEQ ID NO:48;

(8) a F2 polypeptide comprising an amino acid sequence that is at least 97%, 98% or 99% identical to the amino acid sequence of SEQ ID NO:47 and a F1 polypeptide comprising an amino acid sequence that is at least 97%, 98%, or 99% identical to the amino acid sequence of SEQ ID NO:48;

(9) a F2 polypeptide comprising the amino acid sequence of SEQ ID NO: 49 and a F1 polypeptide comprising the amino acid sequence of SEQ ID NO:50;

(10) a F2 polypeptide comprising an amino acid sequence that is at least 97%, 98% or 99% identical to the amino acid sequence of SEQ ID NO:49 and a F1 polypeptide comprising an amino acid sequence that is at least 97%, 98%, or 99% identical to the amino acid sequence of SEQ ID NO:50.

(11) a F2 polypeptide comprising the amino acid sequence of SEQ ID NO:279 and a F1 polypeptide comprising the amino acid sequence of SEQ ID NO:280;

(12) a F2 polypeptide comprising an amino acid sequence that is at least 97%, 98% or 99% identical to the amino acid sequence of SEQ ID NO:279 and a F1 polypeptide comprising an amino acid sequence that is at least 97%, 98%, or 99% identical to the amino acid sequence of SEQ ID NO:280;

(13) a F2 polypeptide comprising the amino acid sequence of SEQ ID NO:281 and a F1 polypeptide comprising the amino acid sequence of SEQ ID NO:282;

(14) a F2 polypeptide comprising an amino acid sequence that is at least 97%, 98% or 99% identical to the amino acid sequence of SEQ ID NO:281 and a F1 polypeptide comprising an amino acid sequence that is at least 97%, 98%, or 99% identical to the amino acid sequence of SEQ ID NO:282;

(15) a F2 polypeptide comprising the amino acid sequence of SEQ ID NO:283 and a F1 polypeptide comprising the amino acid sequence of SEQ ID NO:284;

(16) a F2 polypeptide comprising an amino acid sequence that is at least 97%, 98% or 99% identical to the amino acid sequence of SEQ ID NO:283 and a F1 polypeptide comprising an amino acid sequence that is at least 97%, 98%, or 99% identical to the amino acid sequence of SEQ ID NO:284;

(17) a F2 polypeptide comprising the amino acid sequence of SEQ ID NO:285 and a F1 polypeptide comprising the amino acid sequence of SEQ ID NO:286;

(18) a F2 polypeptide comprising an amino acid sequence that is at least 97%, 98% or 99% identical to the amino acid sequence of SEQ ID NO:285 and a F1 polypeptide comprising an amino acid sequence that is at least 97%, 98%, or 99% identical to the amino acid sequence of SEQ ID NO:286;

(19) a F2 polypeptide comprising the amino acid sequence of SEQ ID NO:287 and a F1 polypeptide comprising the amino acid sequence of SEQ ID NO:288;

(20) a F2 polypeptide comprising an amino acid sequence that is at least 97%, 98% or 99% identical to the amino acid sequence of SEQ ID NO:287 and a F1 polypeptide comprising an amino acid sequence that is at least 97%, 98%, or 99% identical to the amino acid sequence of SEQ ID NO:288;

(21) a F2 polypeptide comprising the amino acid sequence of SEQ ID NO:289 and a F1 polypeptide comprising the amino acid sequence of SEQ ID NO:290; and

(22) a F2 polypeptide comprising an amino acid sequence that is at least 97%, 98% or 99% identical to the amino acid sequence of SEQ ID NO:289 and a F1 polypeptide comprising an amino acid sequence that is at least 97%, 98%, or 99% identical to the amino acid sequence of SEQ ID NO:290.

In some specific embodiments, a trimerization domain is linked to the C-terminus of F1 polypeptide of the F mutant protein. In a particular embodiment, the trimerization domain is a T4 fibritin foldon domain, such as the amino acid sequence GYIPEAPRDGQAYVRKDGEWVLLSTFL (SEQ ID NO: 40).

DETAILED DESCRIPTION OF THE INVENTION

Definitions

The following definitions will be used in the present description and claims:

- the term "harvested cell culture fluid" (or "harvested CCF") refers to a solution containing at least one target substance which is sought to be purified from other substances also present. The harvested CCFs are often complex mixtures containing many biological molecules (such as proteins, antibodies, hormones, and viruses), small molecules (such as salts, sugars, lipids, etc.) and even particulate matter. While a typical harvested CCF of biological origin may be an aqueous solution or suspension, it may also contain organic solvents used in earlier separation steps such as solvent precipitations, extractions, and the like. Examples of harvested CCFs that may contain valuable biological substances amenable to the purification by various embodiments of the present invention include, but are not limited to, a culture supernatant from a bioreactor, a homogenized cell suspension, plasma, plasma fractions, and milk;
- the term "load" refers to any material containing the target substance, either derived from the cell culture (the harvested CCF) or from a chromatography step (thus partially purified), and loaded onto a chromatography medium;
- the term "load challenge" refers to the total mass of substance loaded onto the chromatography medium in the load cycle of a chromatography step, measured in units of mass of substance per unit volume of medium;
- the term "impurities" refers to materials in the harvested CCF that are different from the protein of interest (or target protein) and are desirably excluded from the final therapeutic protein formulation. Typical impurities include nucleic acids, proteins (including HCPs and low molecular weight species, peptides, endotoxins, viruses and small molecules;
- the term "drug substance" refers to the therapeutic protein as an active pharmaceutical ingredient as obtainable by the processes of the present invention;
- the term "drug product" refers to a finished dosage form that contains the therapeutic protein in association with excipients;
- the term "excipients" means the constituents of the final therapeutic protein formulation, which are not the therapeutic protein. The excipients typically include protein stabilizers, surfactants, amino-acids e.g. contributing to protein stabilization, etc. . . . ;
- unless stated otherwise, the term "about" associated with a numeral value means within a range of ±5% of said value.

By "reduction of HCPs" or "enhancing the removal of HCPs", it is meant that the concentration of HCP species present compared to the therapeutic protein is reduced in the eluted pool. The general reduction in HCPs can be measured by methods known in the art, such as HCP ELISA (usually used as the primary tool) and LC-MS/MS.

Starting from a state-of-the-art purification process using a sequence of (a) CEX chromatography step, (b) cHA chromatography step and (c) anion exchange (AEX) chromatography step, the inventors have aimed to determine the main factors affecting the yield.

In particular, it was observed that the CEX step in itself, independently from the other chromatography steps, was associated with a low yield (15-20%).

The inventors have conducted experimental work to determine if low CEX step yield was due to specific CEX resins. To that end, two different CEX resins were examined: Fractogel™-SO3, available from MILLIPORE SIGMA, which has the functional groups attached to polymer tentacles on the resin bead, and UNOsphere™-SO3, available from BIO-RAD.

Purified reactive trimer was loaded on both resins and then eluted. Both the load and the eluted fraction were analyzed by an HIC-HPLC analytic method (Hydrophobic Interaction Chromatography-High Performance Liquid Chromatography).

The experiments revealed that approximately 45% of the RT was converted to NRT on the Fractogel™ resin and 25% of the RT was converted to NRT on the UNOsphere resin. It is believed that the tentacles on the Fractogel™ are responsible for the higher rate of conversion.

In order to prevent the conversion of RT to NRT and thus increase productivity, it was determined that the CEX step would advantageously be removed and replaced by another chromatography step.

Hydrophobic Interaction Chromatography (HIC) was found to be suitable for replacing the CEX step, in particular for the reason that conversion of RT to NRT was prevented or at least minimized.

Positioning of the HIC step in the process flow was found to affect the number of UltraFiltration/DiaFiltration (UFDF) unit operations that are needed. If HIC was used as the capture column, or at the second position, then an additional UFDF step would be required before moving on to the next column. The preferred position of the HIC step was therefore found to be the final polishing step.

Also, since the cHA step in second position provided significant virus clearance, it was decided to keep it in the position in the new process. That resulted in the AEX step moving from the final chromatography step to the first chromatography step and the HIC step positioned third in the new process, the cHA and HIC steps thus defining the polishing steps.

EXAMPLE

The invention will now be further illustrated by the following Example, corresponding to a purification process applied to a recombinantly-produced RSV protein and evaluated with various AEX chromatography wash strategies. The Example is provided for illustrative purpose only and should not be construed as limiting the scope of the invention.

In the illustrative Example, the RSV protein is either an RSV A protein or an RSV B protein.

In this Example, the RSV protein, present in a load solution collected from a bioreactor, is purified by a multi-step purification process that sequentially includes an initial centrifugation and depth filtration step;

a first ultrafiltration/diafiltration step;

an anion exchange (AEX) chromatography step, that is run in a chromatography column comprising the following medium: Fractogel™ EMD TMAE HiCap (M) available from MILLIPORE SIGMA. Alternative media may be used, such as a Q Sepharose™, Capto™ Q or Capto Q ImpRes™ resin, available from GE HEALTHCARE, a TOYOPEARL GigaCap™ Q-650M resin from TOSOH BIOSCIENCE, or a or Eshmuno™ Q resin from MILLIPORE SIGMA. The resin is initially equilibrated with an equilibration buffer. The column is then loaded such that the target protein binds to the resin. The resin is subsequently washed with one or more wash solution(s) and an elution buffer is then applied, whereby the target protein is eluted from the resin in an elution pool. The primary objective of the AEX chromatography step is the separation of the RSV proteins from process-derived impurities;

a carbonate-containing hydroxyapatite (cHA) chromatography step, such as CHT™ Ceramic Hydroxyapatite Type I 40 μm, available from BIO-RAD;

a hydrophobic interaction chromatography (HIC) step, that is run in a chromatography column comprising a medium such as Butyl Sepharose 4 Fast Flow™ resin, available from GE HEALTHCARE;

a virus filtration step using a ViresolvePro™ filter available from MILLIPORE SIGMA. Alternatively, a Planova™ filter, available from ASAHI KASEI, may be used for this virus filtration step;

a second ultrafiltration/diafiltration step; and a final formulation and filtration step.

Anion Exchange Chromatography—Wash Buffer Evaluation

The load solution including the target protein (RSV A or RSV B) and having a pH of 7.5±0.2 is loaded into the Fractogel™ EMD TMAE HiCap (M) column. The column is equilibrated with the following equilibration buffer: 20 mM Tris, 50 mM NaCl pH 7.5. The experiment is run with various load challenge conditions and the column is washed with various wash solutions, as reflected in Table 1 below, before elution of the protein with a 20 mM Tris, 163 mM NaCl pH 7.5 elution buffer.

The protein of interest is in a reactive trimeric form ("Trimer" in Table 1). The "Control pH 7.5 Wash" referred to in Table 1 is a Tris, NaCl wash solution at pH 7.5.

TABLE 1

| Run | Resin Challenge (mg/mL) | Trimer Purity (%) | Product Losses (%) | Pool HCP (mg/L) | HCP LRV |
|---|---|---|---|---|---|
| Common Load Source | | 36 | | 589 | |
| Control pH 7.5 Wash | 15 | 72 | 0 | 244 | 0.5 |
| 70 mM Acetate pH 4.8 | 8 | 89 | 1 | 97 | 1.2 |
| 70 mM Acetate pH 4.8 | 18 | 86 | 16 | 190 | 0.8 |

It can be observed from this experiment that lower pH wash conditions, as compared to more conventional wash solutions at pH of 7.5, can enhance HCP reduction (by ~1 log) with minimal product losses. Such lower pH wash conditions also increase trimer purity (86 and 89% vs. 72%).

The experiment suggests that, in the lower pH wash conditions (pH 4.8 in this Example), the product loss during the low pH wash increases as the load challenge ("Resin Challenge" in Table 1) increases.

Further experiments conducted on acetate wash solutions at various pH, acetate concentrations and load challenges suggest that: lower wash pH correlates with better HCP removal. Lower mass challenge correlates with better HCP removal and better yields. Higher acetate concentration correlates with lower yields.

The results indicate that, among the tested factors, the pH condition is the most significant factor of HCP reduction and that the buffer strength is the most significant factor for product recovery.

Beyond acetate which was used in the above described experiments, alternative anions solution may be used for this method: citrate, phosphate, sulfate, chloride.

Further experiments have been conducted to evaluate the impact of various buffer species with different anion strengths and characterize optimal conditions for HCP removal.

Table 2 below shows the wash conditions (salts, concentration, pH) which were evaluated.

TABLE 2

| Salt | Sodium Citrate | | | | Sodium Acetate | | | | Sodium Phosphate | | Sodium Sulfate | |
|---|---|---|---|---|---|---|---|---|---|---|---|---|
| Concentration (mM) | 20 | 20 | 20 | 20 | 20 | 20 | 20 | 20 | 20 | 20 | 20 | 20 |
| | 30 | 30 | 30 | 30 | 30 | 30 | 30 | 30 | 30 | 30 | 30 | 30 |
| | 50 | 50 | 50 | 50 | 50 | 50 | 50 | 50 | 50 | 50 | 50 | 50 |
| | 70 | 70 | 70 | 70 | 70 | 70 | 70 | 70 | 70 | 70 | 70 | 70 |
| | 90 | 90 | 90 | 90 | 90 | 90 | 90 | 90 | 90 | 90 | 90 | 90 |
| | 110 | 110 | 110 | 110 | 110 | 110 | 110 | 110 | 110 | 110 | 110 | 110 |
| | 130 | 130 | 130 | 130 | 130 | 130 | 130 | 130 | 130 | 130 | 130 | 130 |
| | 150 | 150 | 150 | 150 | 150 | 150 | 150 | 150 | 150 | 150 | 150 | 150 |
| pH | 3.5 | 4 | 4.5 | 5 | 3.5 | 4 | 4.5 | 5 | 3.5 | 5 | 3.5 | 5 |

Figure 2:
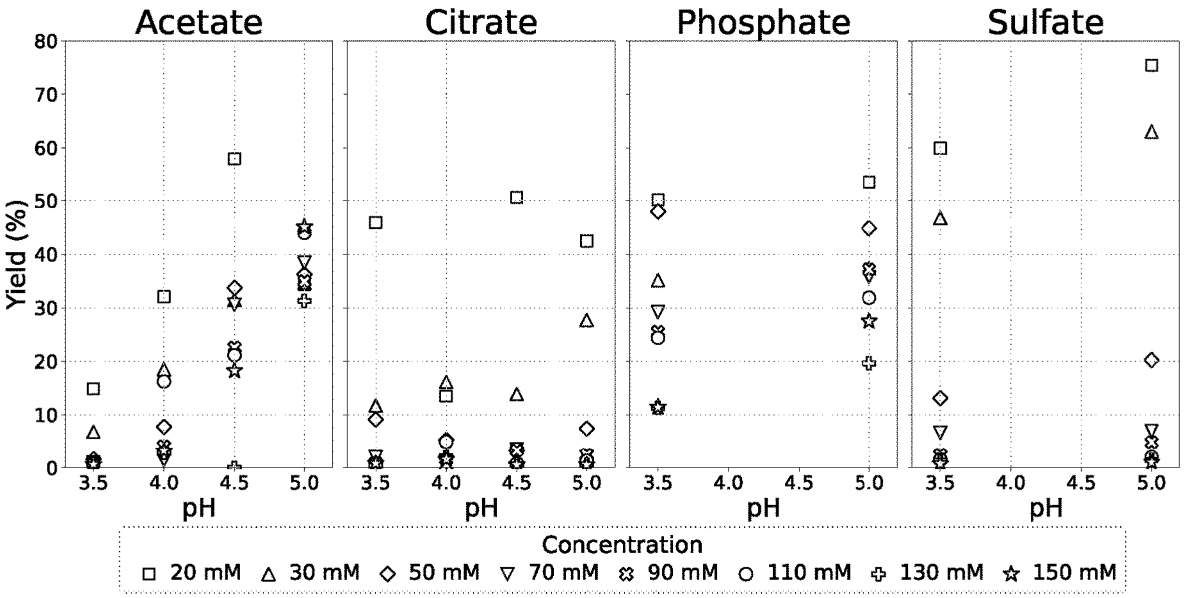

FIG. 1 and FIG. 2 plot the yield values (percentage of product recovery) obtained for each wash solution, against the pH value, respectively for an RSV A and an RSV B load solution.

It will be observed on FIG. 1, for RSV A, that (i) an increased buffer strength leads to lower yields due to product losses during low pH wash;
(ii) acetate and citrate show correlation of yield with wash pH;
(iii) phosphate and sulfate show higher yields at pH 3.5 and are less sensitive to pH.

Data presented on FIG. 2, for RSV B, suggest that (i) a similar trend as for RSV A is observed with acetate i.e. lower pH and increased strength leading to lower yields;
(ii) yield is not as sensitive to high buffer strength as for RSV A;
(iii) lower recoveries are observed for RSVB as compared to RSV A.

In a further experiment, the performance of multiple wash conditions (buffer type, concentration, pH) for both RSV A and RSV B was evaluated in terms of HCP reduction and yield, and compared to the preferred wash solution: 70 mM Acetate, pH 5.0.

The data generated have been collated in Table 3 below.

Finally, with a load solution having a pH between 7.0 and 8.5, and more specifically at about 7.5, and a load challenge comprising between 7.5 and 15.0 mg per ml of the anion exchange chromatography medium, the preferred low pH wash conditions for the AEX chromatography column applicable to both RSV A and RSV B is: 70 mM Acetate and pH 5.0.

Based on the aforementioned experiments, an acceptable range of pH for the low pH wash solution may be between 3.0 and 6.5, more preferably between 4.0 and 6.0, and most preferably between 4.5 and 5.5.

With these operating conditions, phosphate and sulfate are robust options as alternatives to acetate.

In the actual method, prior to loading the load solution including the target protein (RSV A or RSV B) into the AEX column, the column is equilibrated with an equilibration solution: 20 mM Tris, 50 mM NaCl pH 7.5.

After loading, the column is successively washed with three wash solutions, the second one being the lower pH wash solution, the first and third ones being the higher pH wash solutions:

Wash #1: 20 mM Tris, 50 mM NaCl, pH 7.5;
Wash #2: 70 mM Acetate, pH 5.0;
Wash #3: 50 mM Tris, 20 mM NaCl, pH 7.5.

TABLE 3

| Buffer Type | Concentration Range (mM) | pH Range | Yields observed in screen (%) | HPC removal logs of Removal (LRV) | Current process condition in HTS screen: 70 Mm Acetate pH 5 | Expected based on historical process data |
|---|---|---|---|---|---|---|
| RSVA [PF-06934186] | | | | | | |
| Acetate | 20-110 | 5 | 51-83 | 0.7-0.8 | Yield: 51% | Yield: 70% HCP |
| | 20-50 | 4.5 | 51-59 | 0.8 | HCP Removal: | Removal: |
| Phosphate | 20-50 | 3.5 | 65-80 | 0.6-0.7 | ~0.8LRVs | 0.9-1.1 LRVs |
| | 20-110 | 5 | 53-90 | 0.6-0.9 | | |
| Sulfate | 20-30 | 3.5-5 | 65-74 | 0.5-0.6 | | |
| RSVB [PF-06937100] | | | | | | |
| Citrate | 20 | 4.5-5 | 42-50 | 0.8-1.0 | Yield: 38% | Yield: 65% |
| Acetate | 20 | 4.5 | 58 | 0.8 | HCP Removal: | Removal: |
| | 110-150 | 5 | 44-45 | 0.8-0.9 | ~0.8LRVs | 0.9-1.4 LRVs |
| Phosphate | 20 | 3.5-5 | 50-53 | 0.6 | | |
| | 50 | 3.5-5 | 45-48 | 0.7 | | |
| Sulfate | 20-30 | 3.5-5 | 47-75 | 0.5 | | |

In Table 3, the data obtained for the preferred wash solution (70 mM Acetate, pH 5.0) with a high throughput screening (HTS) method—as shown in the penultimate column—have been normalized based on historical data and show for RSV A: a yield of 70% and a log reduction value (LRV) of HCP between 0.9 and 1.1; and
for RSV B: a yield of 65% and an LRV between 0.9 and 1.4.

The conducted wash screens suggest that increased buffer strengths result in yield losses during wash and decreased wash pH result in better HCP removal. RSV A and RSV B showed similar trends with yield and HCP, with RSV B showing lower yields. Different buffers showed a range of effectiveness between HCP removal and yield, in particular phosphate and sulfate which are robust options as alternatives to acetate based on normalized data in Table 3.

The aforementioned pH values and compositions for the wash solutions are those preferred, however acceptable performances in terms of HCP reduction and yield may also be obtained under the following conditions:

the first higher pH wash solution (Wash #1) may have a pH between 7.0 and 8.0. Tris concentration may be between 18 and 22 mM and NaCl concentration may be between 45 and 55 mM;
the concentration of acetate in the lower pH wash solution (Wash #2) may be between 56 and 84 mM, more preferably between 63 and 77 mM. The acceptable ranges of pH, as discussed above, are 3.0-6.5, preferably 4.0-6.0, and more preferably 4.5-5.5;
the second higher pH wash solution (Wash #3) may have a pH between 7.0 and 8.0. Tris concentration may be between 45 and 55 mM and NaCl concentration may be between 18 and 22 mM.

After the washing step performed by washing the column successively with the three wash solutions, the RSV protein is eluted with an elution solution. The elution solution comprises NaCl at a concentration between 146 and 180 mM, preferably at about 163 mM, and Tris at a concentration between 18 and 22 mM, preferably at about 20 mM.

The pH of the elution solution is between 7.0 and 8.0, and is preferably at about 7.5.

The subsequent chromatography steps of the Example are preferably operated in the following conditions.

cHA Chromatography

Prior to loading the product into the cHA chromatography column, the column is equilibrated with a first equilibration buffer 0.5 M sodium phosphate, pH 7.2 and then with a second equilibration buffer 20 mM Tris, 100 mM NaCl, 13 mM sodium phosphate, pH 7.0.

The product pool collected from the AEX chromatography column (i.e. the AEx elution pool) and adjusted with phosphate addition, after filtration, is loaded into the cHA chromatography column. Conditioning the cHA load solution by adding phosphate prior to loading into the column aims to prevent the product from binding to the column. The pH of the load is set at a value of 7.1±0.3 and the load challenge comprises between 8.0 and 12.0 mg per ml of medium.

The column is washed with a wash solution comprising: 20 mM Tris, 100 mM NaCl, 13 mM sodium phosphate at pH 7.0.

The column is operated in a flow-through mode, meaning that, as the load fluid is loaded into the column, the target protein flows through the column while the impurities bind to the medium. The wash is intended to wash the unintentionally bound target proteins out of the column.

HIC

Prior to loading the product into the HIC column, the column is equilibrated with a first equilibration buffer comprising 20 mM potassium phosphate at pH 7.0, and then with a second equilibration buffer comprising 1.1 M potassium phosphate at pH 7.0.

The product pool collected from the cHA chromatography column (i.e. the flow-through pool from the cHA chromatography step) and adjusted with potassium phosphate addition, after filtration, is loaded into the HIC column. Conditioning the HIC load solution by adding phosphate prior to loading into the column aims to ensure that the product binds to the column. The pH and the conductivity of the load are adjusted to respectively 7.0±0.3 and 104±10 mS/cm. The load challenge comprises between 8.0 and 12.0 mg per ml of medium.

The column is operated in a bind and elute mode, whereby the target proteins loaded into the column bind to the medium and then are eluted by applying an elution buffer.

Before applying the elution buffer, the column is washed with a wash solution in order to wash out impurities bound to the medium.

The wash solution used in this HIC step is 1.1 M potassium phosphate, pH 7.0 and the elution buffer is 448 mM potassium phosphate, pH 7.0.

The above-described method is suitable for purifying recombinantly-produced RSV proteins with a sufficient degree of purity, such that said proteins may be used for the preparation of pharmaceutical products. In particular, such purified RSV proteins may be formulated, by addition of suitable excipients, for use as an injectable pharmaceutical product.

SEQUENCE LISTING (326 sequences)

SEQ ID NO: 1 - protein, 574 aa, Human respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 2 - protein, 574 aa, Human respiratory syncytial virus
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 3 - protein, 568 aa, Artificial Sequence
  synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHGSWSHPQFEK

SEQ ID NO: 4 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 5 - protein, 568 aa, Artificial Sequence
  synthetic polypeptide
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHGSWSHPQFEK

SEQ ID NO: 6 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 7 - protein, 568 aa, Artificial Sequence
  synthetic peptide
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHGSWSHPQFEK

SEQ ID NO: 8 - DNA, 1707 bp, Artificial Sequence
  Synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccactgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgtgtggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacatccaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaaatcctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgtgtagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttccgacgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 9 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtacacctgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacatccaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 10 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccactgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttccgacgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 11 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtacaccagcgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgcctgtaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcatgtgcatccggagtggccgtgtccaaagtgctgcatctggagggggaagtgaacaagatcaagtccgccctcctgtcaactaataaggcggtggtgtccctgagcaacggagtcagcgtgctgacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 12 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccacagcgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgcctgtaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcatgtgcatccggagtggccgtgtccaaagtgctgcatctggagggggaagtgaacaagatcaagtccgccctcctgtcaactaataaggcggtggtgtccctgagcaacggagtcagcgtgctgacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaaatcctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 13 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccactgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacatccaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 14 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtacacctgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 15 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccactgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 16 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtacaccagcgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtgtaaagtgctgcatctggagggggaagtgaacaagatcaagtccgccctcctgtcaactaataaggcggtggtgtccctgagcaacggagtcagcgtgctgacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtgcattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 17 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccactgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgtgtggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacatccaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaaatcctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgtgtagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttccagccagttcagtgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 18 - protein, 1707 aa, Artificial Sequence
  synthetic
ATGGAACTTCTGATCCTGAAAGCCAACGCGATTACCACTATCCTGACTGCCGTCACCTTCTGCTTCGCATCGGGACAGAACATTACCGAGGAGTTCTACCAGTCCACCTGTTCGGCGGTGTCCAAGGGTTACCTCTCGGCCCTGAGAACTGGCTGGTACCACAGCGTGATTACTATCGAGCTGAGCAACATCAAGGAGAACAAGTGCAATGGAACGGACGCGAAGGTCAAGCTGATTAAGCAGGAACTCGATAAGTACAAGAACGCCGTGACCGAGCTCCAGCTGCTGATGCAATCGACCCCTGCCACTAACAACAGAGCTCGCCGGGAACTGCCGCGCTTCATGAATTACACCCTCAACAACGCGAAGAAAACCAACGTGACCCTGTCCAAGAAGCGCAAGCGGAGGTTCCTGGGATTCCTGTTGGGCGTGGGCTCCGCAATCGCATCCGGAGTGGCCGTGTGTAAAGTGCTGCATCTGGAGGGGGAAGTGAACAAGATCAAGTCCGCCCTCCTGTCAACTAATAAGGCGGTGGTGTCCCTGAGCAACGGAGTCAGCGTGCTGACAATCAAGGTCCTGGACCTCAAGAACTACATCGACAAGCAGCTGTTGCCCATCGTCAACAAGCAGTCATGCTCGATTAGCAATATCGAAACCGTGATTGAGTTCCAGCAGAAGAACAACAGACTGCTCGAAATTACCCGGGAGTTTTCCGTGAACGCCGGAGTGACCACTCCTGTGTCCACCTACATGCTTACGAACTCCGAACTGCTCAGCCTCATCAACGATATGCCGATCACTAACGACCAGAAGAAGTTGATGAGCAACAATGTGCAGATCGTGCGCCAACAGTCCTACTCAATCATGTGCATTATCAAGGAGGAAATCCTCGCCTATGTGGTGCAATTGCCTCTGTACGGAGTCATCGACACACCCTGCTGGAAGCTGCACACTAGCCCACTCTGTACGACCAACACCAAGGAAGGTTCCAACATCTGCCTGACTAGGACCGATCGGGGCTGGTATTGCGATAATGCTGGGTCCGTGAGCTTCTTCCCGCAAGCCGAGACTTGCAAAGTGCAGTCAAACCGCGTGTTCTGTGACACCATGAACAGCCTGACCCTGCCATCCGAAGTCAACCTCTGCAACGTGGACATCTTTAACCCGAAATACGACTGCAAGATTATGACCTCCAAGACCGACGTCAGCAGCTCTGTCATCACTAGCCTGGGAGCTATTGTGTCCTGCTACGGAAAGACCAAATGCACTGCCTCGAACAAGAACAGAGGCATCATCAAGACCTTCAGCAACGGCTGTGACTACGTGTCCAACAAGGGAGTGGACACCGTGTCCGTCGGGAACACCCTGTACTACGTGAACAAGCAGGAGGGGAAGTCGCTCTACGTCAAGGGGGAACCGATTATCAATTTCTACGACCCCCTGGTGTTCCCTTCCGACGAGTTCGATGCCTCCATATCCCAAGTCAACGAGAAGATCAACCAGTCTCTTGCCTTCATCCGGAAGTCGGACGAACTGCTGTCCGCCATCGGTGGCTATATTCCGGAAGCCCCCAGGGATGGACAGGCCTACGTGCGGAAGGATGGAGAATGGGTGCTTTTGTCCACCTTCCTGGGCGGTCTGGTGCCCCGCGGCTCACACCATCATCACCACCACGGTTCGTGGTCCCACCCTCAATTTGAGAAGTGA

SEQ ID NO: 19 - protein, 568 aa, Artificial Sequence
  synthetic
MELLILKANAITTILTAVTFCFASGQNITEEFYQSTCSAVSKGYLSALRTGWYTSVITIELSNIKENKCNGTDAKVKLIKQELDKYKNAVTELQLLMQSTPACNNRARRELPRFMNYTLNNAKKTNVTLSKKRKRRFLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 20 - protein, 568 aa, Artificial Sequence
  synthetic
MELLILKANAITTILTAVTFCFASGQNITEEFYQSTCSAVSKGYLSALRTGWYHSVITIELSNIKENKCNGTDAKVKLIKQELDKYKNAVTELQLLMQSTPACNNRARRELPRFMNYTLNNAKKTNVTLSKKRKRRFLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 21 - protein, 568 aa, Artificial Sequence
  synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 22 - protein, 126 aa, Artificial Sequence [sequence omitted]

SEQ ID NO: 23 - protein, 108 aa, Artificial Sequence
  synthetic
DIQMTQSPSSLSAAVGDRVTITCQASQDIVNYLNWYQQKPGKAPKLLIYVASNLETGVPSRFSGSGSGTDFSLTISSLQPEDVATYYCQQYDNLPLTFGGGTKVEIKR

SEQ ID NO: 24 - protein, 123 aa, Artificial Sequence
  synthetic
EVQLVESGGGVVQPGRSLRLSCAASGFSFSHYAMHWVRQAPGKGLEWVAVISYDGENTYYADSVKGRFSISRDNSKNTVSLQMNSLRPEDTALYYCARDRIVDDYYYYGMDVWGQGATVTVSS

SEQ ID NO: 25 - protein, 111 aa, Artificial Sequence
  synthetic
DIQMTQSPSSLSASVGDRVTITCQASQDIKKYLNWYHQKPGKVPELLMHDASNLETGVPSRFSGRGSGTDFTLTISSLQPEDIGTYYCQQYDNLPPLTFGGGTKVEIKRTV

SEQ ID NO: 26 - protein, 124 aa, Artificial Sequence
  synthetic
QVQLVQSGAEVKKPGATVKVSCKISGHTLIKLSIHWVRQAPGKGLEWMGGYEGEVDEIFYAQKFQHRLTVIADTATDTVYMELGRLTSDDTAVYFCGTLGVTVTEAGLGIDDYWGQGTLVTVSS

SEQ ID NO: 27 - protein, 108 aa, Artificial Sequence
  synthetic
EIVLTQSPGTLSLSPGERATLSCRASQIVSRNHLAWYQQKPGQAPRLLIFGASSRATGIPVRFSGSGSGTDFTLTINGLAPEDFAVYYCLSSDSSIFTFGPGTKVDFK

SEQ ID NO: 28 - protein, 124 aa, Artificial Sequence
  synthetic
EVQLVESGGGLVKPGGSLRLSCAASGFTFSSYSMNWVRQAPGKGLEWVSSISASSSYSDYADSAKGRFTISRDNAKTSLFLQMNSLRAEDTAIYFCARARATGYSSITPYFDIWGQGTLVTVSS

SEQ ID NO: 29 - protein, 110 aa, Artificial Sequence
  synthetic
QSVVTQTPSVSGAPGQRVTISCTGSSSNIGAGYDVHWYQQLPGTAPKLLIYDNNNRPSGVPDRFSASKSGTSASLAITGLQAEDEADYYCQSYDRNLSGVFGTGTKVTVL

SEQ ID NO: 30 - protein, 120 aa, Artificial Sequence
  synthetic
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARLYGFTYGFAYWGQGTLVTVSA

SEQ ID NO: 31 - protein, 111 aa, Artificial Sequence
  Synthetic
DIVLTQSPASLAVSLGQRATIFCRASQSVDYNGISYMHWFQQKPGQPPKLLIYAASNPESGIPARFTGSGSGTDFTLNIHPVEEEDAATYYCQQIIEDPWTFGGGTKLEIK

SEQ ID NO: 32 - protein, 568 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLCGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMCSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHGSWSHPQFEK

SEQ ID NO: 33 - protein, 568 aa, Artificial Sequence
  Synthetic
MELLILKANAITTILTAVTFCFASGQNITEEFYQSTCSAVSKGYLSALRTGWYTCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 34 - protein, 568 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHGSWSHPQFEK

SEQ ID NO: 35 - protein, 568 aa, Artificial Sequence
  Synthetic
MELLILKANAITTILTAVTFCFASGQNITEEFYQSTCSAVSKGYLSALRTGWYTCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 36 - protein, 568 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 37 - protein, 568 aa, Artificial Sequence
  Synthetic
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 38 - protein, 568 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLCGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMCSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSQFSASISQVNEKINQSLAFIRKSDELLSAIGGYIPEAPRDGQAYVRKDGEWVLLSTFLGGLVPRGSHHHHHHGSWSHPQFEK

SEQ ID NO: 39 - protein, 568 aa, Artificial Sequence
  synthetic
MELLILKANAITTILTAVTFCFASGQNITEEFYQSTCSAVSKGYLSALRTGWYHSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHGSWSHPQFEK

SEQ ID NO: 40 - protein, 26 aa, Artificial Sequence
  Synthetic
YIPEAPRDGQAYVRKDGEWVLLSTFL

SEQ ID NO: 41 - protein, 84 aa, Artificial Sequence
  synthetic polypeptide
QNITEEFYQSTCSAVSKGYLSALRTGWYTSVITIELSNIKENKCNGTDAKVKLIKQELDKYKNAVTELQLLMQSTPACNNRARR

SEQ ID NO: 42 - protein, 377 aa, Artificial Sequence
  synthetic polypeptide
FLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 43 - protein, 84 aa, Artificial Sequence
  synthetic polypeptide
QNITEEFYQSTCSAVSKGYLSALRTGWYTSVITIELSNIKENKCNGTDAKVKLIKQELDKYKNAVTELQLLMQSTPPCNNRARR

SEQ ID NO: 44 - protein, 377 aa, Artificial Sequence
  synthetic polypeptide
FLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSSEFDASISQVNEKINQSLAFIRKSDELL

SEQ ID NO: 45 - protein, 84 aa, Artificial Sequence
  synthetic polypeptide
QNITEEFYQSTCSAVSKGYLSALRTGWYTSVITIELSNIKENKCNGTDAKVKLIKQELDKYKNAVTELQLLMQSTPACNSRARR

SEQ ID NO: 46 - protein, 377 aa, Artificial Sequence
  synthetic polypeptide
FLGFLLGVGSACASGIAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 47 - protein, 84 aa, Artificial Sequence
  synthetic polypeptide
QNITEEFYQSTCSAVSRGYFSALRTGWYTSVITIELSNIKETKCNGTDTKVKLIKQELDKYKNAVTELQLLMQNTPACNNRARR

SEQ ID NO: 48 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 49 - protein, 84 aa, Artificial Sequence; identical to SEQ ID NO: 47
  synthetic polypeptide

SEQ ID NO: 50 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 51 - protein, 84 aa, Artificial Sequence
  synthetic polypeptide
QNITEEFYQSTCSAVSKGYLSALRTGWYHSVITIELSNIKENKCNGTDAKVKLIKQELDKYKNAVTELQLLMQSTPACNNRARR

SEQ ID NO: 52 - protein, 377 aa, Artificial Sequence
  synthetic polypeptide
FLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 53 - protein, 84 aa, Artificial Sequence
  synthetic polypeptide
QNITEEFYQSTCSAVSKGYLSALRTGWYHSVITIELSNIKENKCNGTDAKVKLIKQELDKYKNAVTELQLLMQSTPPCNNRARR

SEQ ID NO: 54 - protein, 377 aa, Artificial Sequence
  synthetic polypeptide
FLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSSEFDASISQVNEKINQSLAFIRKSDELL

SEQ ID NO: 55 - protein, 84 aa, Artificial Sequence
  synthetic polypeptide
QNITEEFYQSTCSAVSKGYLSALRTGWYHSVITIELSNIKENKCNGTDAKVKLIKQELDKYKNAVTELQLLMQSTPACNSRARR

SEQ ID NO: 56 - protein, 377 aa, Artificial Sequence
  synthetic polypeptide
FLGFLLGVGSACASGIAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 57 - protein, 84 aa, Artificial Sequence
  synthetic polypeptide
QNITEEFYQSTCSAVSRGYFSALRTGWYHSVITIELSNIKETKCNGTDTKVKLIKQELDKYKNAVTELQLLMQNTPACNNRARR

SEQ ID NO: 58 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEILAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 59 - protein, 84 aa, Artificial Sequence; identical to SEQ ID NO: 57
  synthetic polypeptide

SEQ ID NO: 60 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEILAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 61 - protein, 84 aa, Artificial Sequence
  synthetic polypeptide
QNITEEFYQSTCSAVSKGYLSALRTGWYHCVITIELSNIKENKCNGTDAKVKLIKQELDKYKNAVTELQLLMQSTPATNNRARR

SEQ ID NO: 62 - protein, 377 aa, Artificial Sequence
  synthetic polypeptide
FLGFLLGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 63 - protein, 84 aa, Artificial Sequence
  synthetic polypeptide
QNITEEFYQSTCSAVSKGYLSALRTGWYHCVITIELSNIKENKCNGTDAKVKLIKQELDKYKNAVTELQLLMQSTPPTNNRARR

SEQ ID NO: 64 - protein, 377 aa, Artificial Sequence
  synthetic polypeptide
FLGFLLGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSSEFDASISQVNEKINQSLAFIRKSDELL

SEQ ID NO: 65 - protein, 84 aa, Artificial Sequence
  synthetic polypeptide
QNITEEFYQSTCSAVSKGYLSALRTGWYHCVITIELSNIKENKCNGTDAKVKLIKQELDKYKNAVTELQLLMQSTPAANSRARR

SEQ ID NO: 66 - protein, 377 aa, Artificial Sequence
  synthetic polypeptide
FLGFLLGVGSAIASGIAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 67 - protein, 84 aa, Artificial Sequence
  synthetic polypeptide
QNITEEFYQSTCSAVSRGYFSALRTGWYHCVITIELSNIKETKCNGTDTKVKLIKQELDKYKNAVTELQLLMQNTPAANNRARR

SEQ ID NO: 68 - protein, 377 aa, Artificial Sequence
  synthetic polypeptide
FLGFLLGVGSAIASGIAVSKVLHLEGEVNKIKNALLSTNKAVVSLSNGVSVCTSKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 69 - protein, 84 aa, Artificial Sequence; identical to SEQ ID NO: 67
  synthetic polypeptide

SEQ ID NO: 70 - protein, 377 aa, Artificial Sequence
  synthetic polypeptide
FLGFLLGVGSAIASGIAVSKVLHLEGEVNKIKNALLSTNKAVVSLSNGVSVCTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 71 - protein, 84 aa, Artificial Sequence; identical to SEQ ID NO: 61
  synthetic polypeptide

SEQ ID NO: 72 - protein, 377 aa, Artificial Sequence
  synthetic polypeptide
FLGFLLGVGSAIASGVAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 73 - protein, 84 aa, Artificial Sequence; identical to SEQ ID NO: 63
  synthetic polypeptide

SEQ ID NO: 74 - protein, 377 aa, Artificial Sequence
  synthetic polypeptide
FLGFLLGVGSAIASGVAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSSEFDASISQVNEKINQSLAFIRKSDELL

SEQ ID NO: 75 - protein, 84 aa, Artificial Sequence; identical to SEQ ID NO: 65
  synthetic polypeptide

SEQ ID NO: 76 - protein, 377 aa, Artificial Sequence
  synthetic polypeptide
FLGFLLGVGSAIASGIAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 77 - protein, 84 aa, Artificial Sequence; identical to SEQ ID NO: 67
  synthetic polypeptide

SEQ ID NO: 78 - protein, 377 aa, Artificial Sequence
  synthetic polypeptide
FLGFLLGVGSAIASGIAVSKVLHLEGEVNKIKNALLSTNKAVVSLSNGVSVCTIKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 79 - protein, 84 aa, Artificial Sequence; identical to SEQ ID NO: 67
  synthetic polypeptide

SEQ ID NO: 80 - protein, 377 aa, Artificial Sequence
  synthetic polypeptide
FLGFLLGVGSAIASGIAVSKVLHLEGEVNKIKNALLSTNKAVVSLSNGVSVCTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 81 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKADVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 82 - protein, 573 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFS

SEQ ID NO: 83 - protein, 574 aa, Human respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 84 - protein, 574 aa, Human respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 85 - protein, 574 aa, Human respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKEQLSGINNIAFSN

SEQ ID NO: 86 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYFKARSTPVTLSKDQLSGINNIAFSN

SEQ ID NO: 87 - protein, 574 aa, Human respiratory syncytial virus
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 88 - protein, 574 aa, Human respiratory syncytial virus
  misc_feature (91)..(91): Xaa can be any naturally occurring amino acid
  misc_feature (363)..(363): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVXELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSXRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 89 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKNNNVTLSNKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 90 - protein, 574 aa, Human respiratory syncytial virus
MDLPILKTNAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 91 - protein, 574 aa, Human respiratory syncytial virus
MDLPILKTNAITTILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 92 - protein, 574 aa, Human respiratory syncytial virus
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 93 - protein, 574 aa, Human respiratory syncytial virus
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 94 - protein, 569 aa, Human respiratory syncytial virus
MDLPILKTNAITAILAVVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINN

SEQ ID NO: 95 - protein, 574 aa, Human respiratory syncytial virus
MDLPILKTKAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNNKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 96 - protein, 574 aa, Human respiratory syncytial virus
MELPILKTNAITTILTAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTLSKDQLSGINNIAFSN

SEQ ID NO: 97 - protein, 574 aa, Human respiratory syncytial virus
MELPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTLSKDQLSGINNIAFSN

SEQ ID NO: 98 - protein, 574 aa, Human respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 99 - protein, 574 aa, Human respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTVINDQLSGINNIAFSN

SEQ ID NO: 100 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSISFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLCVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 101 - protein, 574 aa, Human respiratory syncytial virus
  misc_feature (272)..(272): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTANVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKXLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 102 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 103 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 104 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 105 - protein, 574 aa, Human respiratory syncytial virus
MELPILKTNVITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 106 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 107 - protein, 573 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFS

SEQ ID NO: 108 - protein, 574 aa, Human respiratory syncytial virus
MELPILKTNAITTILAAVTLCFASSQNITEEFYQSTCSAVSKGYLSALRTGWYTSVITIELSSIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMFNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 109 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPVVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 110 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTVSKDQLSGINNIAFSN

SEQ ID NO: 111 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSS

SEQ ID NO: 112 - protein, 574 aa, Human respiratory syncytial virus
MELPILKTNTITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAVKSTTNIMITTIIIVIIVILLSLIAVGLLLYCKARSTPVTLSKDQLSGINNIAFSN

SEQ ID NO: 113 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 114 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 115 - protein, 573 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFS

SEQ ID NO: 116 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKYDELLHNVNAGKSTTNIMITTIIIVIIVILLSLIAVGLLLYCKARSTPVTLSKDQLSGINNIAFSN

SEQ ID NO: 117 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSNEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 118 - protein, 574 aa, Human respiratory syncytial virus
MELPVLKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 119 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 120 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 121 - protein, 574 aa, Human respiratory syncytial virus
  misc_feature (32)..(32): Xaa can be any naturally occurring amino acid
MELPILKTNAITTILAAVTLCFASSQNITEEXYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 122 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 123 - protein, 574 aa, Human respiratory syncytial virus
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 124 - protein, 574 aa, Human respiratory syncytial virus
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNKKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 125 - protein, 574 aa, Human respiratory syncytial virus
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTSIMITTIIIVIIVILLSLIAVGLLLYCKARSTPVTLSKDQLSGINNIAFSN

SEQ ID NO: 126 - protein, 574 aa, Human respiratory syncytial virus
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKIHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 127 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 128 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPFDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 129 - protein, 574 aa, Human respiratory syncytial virus
MELPILKTNAITTILAAVTLCFASSQNITEEFYQSTCSAVSKGYLSALRTGWYTSVITIELSTIKENKCNGTDAKVKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 130 - protein, 574 aa, Human respiratory syncytial virus
MELPILKTNAITTILAAVTLCFASSQNITEEFYQSTCSAVSKGYLSALRTGWYTSVITIELSTIKENKCNGTDAKGKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTKIMITTIIIVIIVILLSLIAVGLLLYCKARSTPVTLSKDQLSGINNIAFSS

SEQ ID NO: 131 - protein, 574 aa, Human respiratory syncytial virus
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 132 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 133 - protein, 574 aa, Human respiratory syncytial virus
MELPILKTNAITTILAAVTLCFVSSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 134 - protein, 565 aa, Human respiratory syncytial virus
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQTVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKIDQSLAFIRKSDELLHNVNAGKSTTNIMITTIIIVIIVILLALIAVGLLLYCKARSTPVTLSKDQLR

SEQ ID NO: 135 - protein, 574 aa, Human respiratory syncytial virus
MELPILKANAISTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 136 - protein, 574 aa, Human respiratory syncytial virus; identical to SEQ ID NO: 4

SEQ ID NO: 137 - protein, 569 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 138 - protein, 569 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVITVILLALIAVGLLLYCKARSTPVTLSKDQLSGINN

SEQ ID NO: 139 - protein, 569 aa, Human respiratory syncytial virus
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 140 - protein, 569 aa, Human respiratory syncytial virus
MELPILKTNAITTILAAVILCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 141 - protein, 569 aa, Human respiratory syncytial virus
MELPILKTNAITTILAAVTLCFASSQNITEEFYQSTCSAVSKGYLSALRTGWYTSVIAIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 142 - protein, 569 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPISTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 143 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDTSISQVNEKINQSLAFIRKSDELLHNVNAGKSTTNIMITTIIIVIIVILLALIAVGLLLYCKARSTPVTLSKDQLSGINNIAFSN

SEQ ID NO: 144 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRTRRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 145 - protein, 574 aa, Human respiratory syncytial virus
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 146 - protein, 574 aa, Human respiratory syncytial virus
MELPILKTNAITTILAAVTLCFSSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 147 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 148 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGTAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 149 - protein, 574 aa, Human respiratory syncytial virus
  misc_feature (292)..(292): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIXKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 150 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISLVNEKINQSLAFIRKSDELLHNVNAGKSTTNIMITTIIIVIIVILLALIAVGLLLYCKARSTPVTLSKDQLSGINNIAFSN

SEQ ID NO: 151 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSILNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 152 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPSANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 153 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKVGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 154 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKARSTPVTLSKDQLSGINNIAFSN

SEQ ID NO: 155 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNANVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 156 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNINVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 157 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPTANSRARRELPRFMNYTLNNTKNINVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 158 - protein, 569 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNIKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 159 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNIKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 160 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 161 - protein, 574 aa, Human respiratory syncytial virus
MELPILKTNAITTILAAITLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 162 - protein, 574 aa, Human respiratory syncytial virus
MELPILKTNAITTILAAITLCFASSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 163 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 164 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 165 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNFCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 166 - protein, 574 aa, Human respiratory syncytial virus
MELPILKTNSITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 167 - protein, 574 aa, Human respiratory syncytial virus
MELPILKTNAITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 168 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLFMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 169 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLFMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 170 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLGKDQLSGINNIAFNN

SEQ ID NO: 171 - protein, 574 aa, Human respiratory syncytial virus
MELPILKTNAITIILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSAPVTLSKDQLSGINNIAFSN

SEQ ID NO: 172 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNSTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQINEKINQSLAFIRKSDELLHNVNAGKSTTNIMITTIIIVIIVILLALIAVGLLLYCKARSTPVTLSKDQLSGINNIAFSN

SEQ ID NO: 173 - protein, 574 aa, Human respiratory syncytial virus
MELPILKINAITTILAAITLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSN

SEQ ID NO: 174 - protein, 573 aa, Human respiratory syncytial virus
MELPILKTNAITTILAAATLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCENAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFS

SEQ ID NO: 175 - protein, 573 aa, Human respiratory syncytial virus
MELPILKTNAITTILAAAILCFTSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCRARSTPVTLSKDQLSGINNIAFS

SEQ ID NO: 176 - protein, 574 aa, Human respiratory syncytial virus
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSFIDGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSN

SEQ ID NO: 177 - protein, 574 aa, Human respiratory syncytial virus
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKDRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 178 - protein, 574 aa, Human respiratory syncytial virus
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 179 - protein, 574 aa, Human respiratory syncytial virus
MELPILKTNAITAILAAVTLCFASSQNITEEFYQTTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 180 - protein, 574 aa, Human respiratory syncytial virus
MELPILKANAITTILAAVTLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 181 - protein, 574 aa, Human respiratory syncytial virus
MELPILKANAITTILTAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIVVILLSLIVVGLLLYCKARSTPVTLSKDQLSGINNIAFSS

SEQ ID NO: 182 - protein, 574 aa, Human respiratory syncytial virus
MELPILKANAITTILAAVILCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIVVILLSLIVVGLLLYCKARSTPVTLSKDQLSGINNIAFSS

SEQ ID NO: 183 - protein, 574 aa, Human respiratory syncytial virus
MELPILKTNAITTILAAVTLCFASSQNITEEFYQSTCSAVSKGYLSALRTGWYTSVITIELSNIKENKCNGTDAKAKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLHLKNYIDKQFLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSS

SEQ ID NO: 184 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 185 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVDKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 186 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYGCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 187 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 188 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCRIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 189 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFEASISQVNEKINQSLAFIRKSDELLHHVNAGKSTTNIMITTIIIVIIVILLSLIAVGLLLYCKARSTPVTLSKDQLSGINNIAFSN

SEQ ID NO: 190 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGLLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 191 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGAGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 192 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNVGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 193 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 194 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 195 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKNLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 196 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKMLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 197 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKTLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 198 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKQLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 199 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKELMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 200 - protein, 574 aa, Human respiratory syncytial virus
MELPILKANAITTILAAVTFCFASSQNITEEFYQSTCSAVSKGYLSALRTGWYTSVITIELSNIKENKCNGTDAKVKLINQELDKYKNAVTELQLLMQSTTAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 201 - protein, 574 aa, Human respiratory syncytial virus
MELPILKANAITTILAAVTFCFASSQNITEEFYQSTCSAVSKGYLSALRTGWYTSVITIELSNIKKNKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSRVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAEKCKVQSNRVFCDTMYSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPITLSKDQLSGINNIAFSN

SEQ ID NO: 202 - protein, 574 aa, Human respiratory syncytial virus
  misc_feature (428)..(435): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVTELQLLMQSAPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKXXXXXXXXSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 203 - protein, 574 aa, Human respiratory syncytial virus
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTVIDDYLSGINNISFIY

SEQ ID NO: 204 - protein, 574 aa, Human respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 205 - protein, 574 aa, Human respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 206 - protein, 574 aa, Human respiratory syncytial virus
MELLILKANAITTILTAVTFCFASGQNITEEFYQSTCSAVSKGYLSALRTGWYTSVITIELSNIKKNKCNGTDAKIKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAVKSTTNIMITTIIIVIIVILLSLIAVGLLLYCKARSTPVTLSKDQLSGINNIAFSN

SEQ ID NO: 207 - protein, 574 aa, Human respiratory syncytial virus
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQVLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 208 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 209 - protein, 574 aa, Human respiratory syncytial virus
MELPIIKANAITTILIAVTFCFASSQNITEEFYQSTCSAVSKGYLSALRTGWYTSVITIELSNIKENKCNGTDAKVKLIKQELDKYKNAVTELQLLMQSTTAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 210 - protein, 574 aa, Human respiratory syncytial virus
MELPILKTNAITTIFAAVTLCFASSQNITEEFYQSTCSAVSKGYLSALRTGWYTSVITVELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 211 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 212 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 213 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 214 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGVAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 215 - protein, 574 aa, Human respiratory syncytial virus
MELLIYRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 216 - protein, 574 aa, Human respiratory syncytial virus
  misc_feature (275)..(275): Xaa can be any naturally occurring amino acid
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMXSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVRGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 217 - protein, 574 aa, Human respiratory syncytial virus
  misc_feature (272)..(272): Xaa can be any naturally occurring amino acid
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKXLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 218 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMLSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 219 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTHMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 220 - protein, 573 aa, Human respiratory syncytial virus
MELLIHRSSAIFLTLAINALYLTSSQNITEEFYQSTCSVVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 221 - protein, 573 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 222 - protein, 573 aa, Human respiratory syncytial virus
MELLIHRSSAIFLTFAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 223 - protein, 573 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPHYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 224 - protein, 564 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQL

SEQ ID NO: 225 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 226 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 227 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSTSKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 228 - protein, 574 aa, Human respiratory syncytial virus
MELLIHRSSAIFLTLAINALYLTSSQNITEEFYQSTCSAVSRGYFSALRTGWYTSVITIELSNIKEIKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDSSISQVNEKINQSLAFIRRSDELLHNVNTGKSTTNIMITAIIIVIIVVLLSLIAIGLLLYCKAKNTPVTLSKDQLSGINNIAFSK

SEQ ID NO: 229 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFGVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 230 - protein, 573 aa, Human respiratory syncytial virus
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 231 - protein, 573 aa, Human respiratory syncytial virus
MELVIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSVIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 232 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 233 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPTANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 234 - protein, 574 aa, Human respiratory syncytial virus
MELLIHRSSAIFLTLAINAFYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 235 - protein, 573 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 236 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 237 - protein, 573 aa, Human respiratory syncytial virus
ELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 238 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIIITAIIIVIIVVLLSLIAIGLLLYCKAKNTPVTLSKDQLSGINNIAFSK

SEQ ID NO: 239 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREASQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 240 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKIQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 241 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 242 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNARVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 243 - protein, 574 aa, Human respiratory syncytial virus
MELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 244 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 245 - protein, 574 aa, Human respiratory syncytial virus
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 246 - protein, 574 aa, Human respiratory syncytial virus
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQICRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 247 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTRNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 248 - protein, 574 aa, Human respiratory syncytial virus
MELLIYRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 249 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 250 - protein, 573 aa, Human respiratory syncytial virus
MELLIHRSSAIFLTLSINALYLTSSQNITEEFYQSTCSAVSRGYFSALRTGWYTSVITIELSNIKETKCNGTDTKVKLIKQELDKYKNAVTELQLLMQNTPATNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTQCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 251 - protein, 574 aa, Human respiratory syncytial virus
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIGTVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 252 - protein, 574 aa, Human respiratory syncytial virus
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 253 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLTQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKSYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 254 - protein, 574 aa, Human respiratory syncytial virus
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAVNNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKELMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 255 - protein, 564 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITRGFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLCYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKTTPVTLSKDQL

SEQ ID NO: 256 - protein, 564 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISTIETVIEFQQKNSRLLEINREFSVNAGVTTPLSTYMLTNSELLSLINDMPITNDQKKLMSSNVQIVRQQSYSIMSIIKEEVLAYVVRLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKTTPVTLSKDQL

SEQ ID NO: 257 - protein, 573 aa, Human respiratory syncytial virus
MELLIHRSSAVFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCRAKNTPVTLSKDQLSGINNIAFR

SEQ ID NO: 258 - protein, 574 aa, Human respiratory syncytial virus
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNGELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKEQLSGINNIAFSK

SEQ ID NO: 259 - protein, 574 aa, Human respiratory syncytial virus
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPVANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNTKEGSNICLTRTDRGWYCDNAGSVSFFPQADTCKVQSNRVFCDTMYSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 260 - protein, 574 aa, Human respiratory syncytial virus
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGISVLTSKVLDLKNYINNRLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 261 - protein, 574 aa, Human respiratory syncytial virus; identical to SEQ ID NO: 211

SEQ ID NO: 262 - protein, 574 aa, Human respiratory syncytial virus
MELLIHRSIAIFLTLAINALYLTSSQNITEEFYQSTCSAVSRGYFSALRTGWYTSVITIELSNITETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNVGKSTTNIMITAIIIVIIVVLLSLIAIGLLLYCKAKNTPVTLSKDQLSGINNIAFSK

SEQ ID NO: 263 - protein, 574 aa, Human respiratory syncytial virus
MELLVHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTNNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 264 - protein, 574 aa, Bovine respiratory syncytial virus
MAATAMRMIISIIFISTYMTHITLCQNITEEFYQSTCSAVSRGYLSALRTGWYTSVVTIELSKIQKNVCKSTDSKVKLIKQELERYNNAVIELQSLMQNEPASFSRAKRGIPELIHYTRNSTKRFYGLMGKKRKRRFLGFLLGIGSAIASGVAVSKVLHLEGEVNKIKNALLSTNKAVVSLSNGVSVLTSKVLDLKNYIDKELLPKVNNHDCRISNIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 265 - protein, 574 aa, Bovine respiratory syncytial virus
MATTAMTMIISIIFISTYVTHITLCQNITEEFYQSTCSAVSRGYLSALRTGWYTSVVTIELSKIQKNVCKSTDSKVKLIKQELERYNNAVVELQSLMQNEPASFSRAKRSIPELIHYTRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCRISNIATVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 266 - protein, 574 aa, Bovine respiratory syncytial virus
MATTAMRMIISIIFISTYVTHITLCQNITEEFYQSTCSAVSRGYLSALRTGWYTSVVTIELSKIQKNVCNSTDSKVKLIKQELERYNNAVVELQSLMQNEPASFSRAKRGIPELIHYTRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCRISKIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQTETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTKSTPIMLGKDQLSGINNLSFSK

SEQ ID NO: 267 - protein, 574 aa, Bovine respiratory syncytial virus
MATTAMRMIISIIFISTYVTHITLCQNITEEFYQSTCSAVSRGYLSALRTGWYTSVVTIELSKIQKNVCKSTDSKVKLIKQELERYNNAVVELQSLMQNEPASFSRAKRGIPELIHYTRNSTKKFYGLMGKKRKRRFLGFLLGIGSAVASGVAVSKVLHLEGEVNKIKNALLSTNKAVVSLSNGVSVLTSKVLDLKNYIDKELLPQVNNHDCRISNIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQTETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTKSTPIMLGKDQLSGINNLSFSK

SEQ ID NO: 268 - protein, 574 aa, Bovine respiratory syncytial virus
MATTAMRMIISIIFISTYVTHITLCQNITEEFYQSTCSAVSRGYLSALRTGWYTSVVTIELSKIQKNVCKSTDSKVKLIKQELERYNNAVVELQSLMQNEPGSFSRAKRGIPELIHYTRNSTKKFYGHMGKKRKRRFLGFLLGIGSAIASGVAVSKVLHLEGEVNKIKNALLSTNKAVVSLSNGVSVLTSKVLDLKNYIDKELLPKVNNHDCRISNIETVIDFQQKNNRLLEIAREFSVNAGITTPLSTYMLTNSELLSLINDMPITNDQKKLMSSNVQIVRQQSYSIMSVVKEEVMAYVVQLPIYGVIDTPCWKLHTSPLCTTDNKEGSNICLTRTDRGWYCDNAGSVSFFPQAETCKVQSNRVFCDTMNSLTLPTDVNLCNTDIFNAKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 269 - protein, 574 aa, Bovine respiratory syncytial virus
MGTTAMRMVISIIFISTYVTHITLCQNITEEFYQSTCSAVSRGYLSALRTGWYTSVVTIELSKIQKNVCKSTDSKVKLIKQELERYNNAVIELQSLMQNEPASFSRAKRGIPELIHYPRNSTKRFYGLMGKKRKRRFLGFLLGIGSAIASGVAVSKVLHLEGEVNKIKNALLSTNKAVVSLSNGVSVLTSKVLDLKNYIDKELLPKVNNHDCRISNIGTVIEFQQKNNRLLEIAREFSVNAGITTPLSTYMLTNSELLSLINDMPITNDQKKLMSSNVQIVRQQSYSIMSVVKEEVIAYEVQLPIYGVIDTPCWKIHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFPIGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 270 - protein, 569 aa, Bovine respiratory syncytial virus
MRMIISIILISTYVPHITLCQNITEEFYQSTCSAVSRGYLSALRTGWYTSVVTIELSKIQKNVCNGTDSKVKLIKQELERYNNAVVELQSLMQNEPTSSSRAKRGIPESIHYTRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCRISNIATVIEFQQKNNRLLEIAREFSVNAGITTPLSTYMLTNSELLSIINDMPITNDQKKLMSSNVQIVRQQSYSIMSVVKEEVIAYVVQLPLYGVIDTPCWKLHTSPLCTTDNEEGSNICLTRTDRGWYCDNAGSVSFFPQAETCKVQSNRVFCDTMNSLTLPTDVNLCNTDIFNAKYDCKIMTSKTDISSSVITSIGAIVSCYGKTKCTASNKNRGIIKTFSNGCDYVSNKGVDTVSVGNTLYYVNKLEGKALYIKGEPIINYYNPLVFPSDEFDASIAQVNAKINQSLAFIRRSDELLHSVDVGKSTTNVVITTIIIVIVVVILMLITVGLLFYCKTRSTPIMLGKDQLSSINNLSFSK

SEQ ID NO: 271 - protein, 537 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLGGLVPRGSHHHHHHGSWSHPQFEK

SEQ ID NO: 272 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRCCDELLHNVNAGKSTTNIMITTLVPRGSGGSAIGGYIPEAPRDGQAYVRKDGEWVLLSTFLGGHHHHHHGSWSHPQFEK

SEQ ID NO: 273 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLHCCNAGKSTTNIMITTLVPRGSGGSAIGGYIPEAPRDGQAYVRKDGEWVLLSTFLGGHHHHHHGSWSHPQFEK

SEQ ID NO: 274 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLHNVNAGKSCCNIMITTLVPRGSGGSAIGGYIPEAPRDGQAYVRKDGEWVLLSTFLGGHHHHHHGSWSHPQFEK

SEQ ID NO: 275 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRCCDELLHCCNAGKSTTNIMITTLVPRGSGGSAIGGYIPEAPRDGQAYVRKDGEWVLLSTFLGGHHHHHHGSWSHPQFEK

SEQ ID NO: 276 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRCCDELLHNVNAGKSCCNIMITTLVPRGSGGSAIGGYIPEAPRDGQAYVRKDGEWVLLSTFLGGHHHHHHGSWSHPQFEK

SEQ ID NO: 277 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLHCCNAGKSCCNIMITTLVPRGSGGSAIGGYIPEAPRDGQAYVRKDGEWVLLSTFLGGHHHHHHGSWSHPQFEK

SEQ ID NO: 278 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRCCDELLHCCNAGKSCCNIMITTLVPRGSGGSAIGGYIPEAPRDGQAYVRKDGEWVLLSTFLGGHHHHHHGSWSHPQFEK

SEQ ID NO: 279 - protein, 84 aa, Artificial Sequence; identical to SEQ ID NO: 41
  synthetic polypeptide

SEQ ID NO: 280 - protein, 377 aa, Artificial Sequence
  synthetic polypeptide
FLGFLLGVGSACASGIAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 281 - protein, 84 aa, Artificial Sequence; identical to SEQ ID NO: 41
  synthetic polypeptide

SEQ ID NO: 282 - protein, 377 aa, Artificial Sequence; identical to SEQ ID NO: 280
  synthetic polypeptide

SEQ ID NO: 283 - protein, 84 aa, Artificial Sequence; identical to SEQ ID NO: 41
  synthetic polypeptide

SEQ ID NO: 284 - protein, 377 aa, Artificial Sequence; identical to SEQ ID NO: 280
  synthetic polypeptide

SEQ ID NO: 285 - protein, 84 aa, Artificial Sequence; identical to SEQ ID NO: 47
  synthetic polypeptide

SEQ ID NO: 286 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 287 - protein, 84 aa, Artificial Sequence; identical to SEQ ID NO: 47
  synthetic polypeptide

SEQ ID NO: 288 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 289 - protein, 84 aa, Artificial Sequence
  synthetic polypeptide
QNITEEFYQSTCSAVSRGYLSALRTGWYTSVITIELSNIKETKCNGTDTKVKLIKQELDKYKNAVTELQLLMQNTPACNNRARR

SEQ ID NO: 290 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 291 - protein, 84 aa, Artificial Sequence; identical to SEQ ID NO: 51
  synthetic polypeptide

SEQ ID NO: 292 - protein, 377 aa, Artificial Sequence
  synthetic polypeptide
FLGFLLGVGSACASGIAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 293 - protein, 84 aa, Artificial Sequence; identical to SEQ ID NO: 51
  synthetic polypeptide

SEQ ID NO: 294 - protein, 377 aa, Artificial Sequence; identical to SEQ ID NO: 292
  synthetic polypeptide

SEQ ID NO: 295 - protein, 84 aa, Artificial Sequence; identical to SEQ ID NO: 51
  synthetic polypeptide

SEQ ID NO: 296 - protein, 377 aa, Artificial Sequence; identical to SEQ ID NO: 292
  synthetic polypeptide

SEQ ID NO: 297 - protein, 84 aa, Artificial Sequence; identical to SEQ ID NO: 57
  synthetic polypeptide

SEQ ID NO: 298 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEILAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 299 - protein, 84 aa, Artificial Sequence; identical to SEQ ID NO: 57
  synthetic polypeptide

SEQ ID NO: 300 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEILAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 301 - protein, 84 aa, Artificial Sequence
  synthetic polypeptide
QNITEEFYQSTCSAVSRGYLSALRTGWYHSVITIELSNIKETKCNGTDTKVKLIKQELDKYKNAVTELQLLMQNTPACNNRARR

SEQ ID NO: 302 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEILAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 303 - protein, 84 aa, Artificial Sequence
  synthetic polypeptide
QNITEEFYQSTCSAVSKGYLSALRTGWYHCVITIELSNIKENKCNGTDAKVKLIKQELDKYKNAVTELQLLMQSTPAANNRARR

SEQ ID NO: 304 - protein, 377 aa, Artificial Sequence
  synthetic polypeptide
FLGFLLGVGSAIASGIAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 305 - protein, 84 aa, Artificial Sequence; identical to SEQ ID NO: 303
  synthetic polypeptide

SEQ ID NO: 306 - protein, 377 aa, Artificial Sequence; identical to SEQ ID NO: 304
  synthetic polypeptide

SEQ ID NO: 307 - protein, 84 aa, Artificial Sequence; identical to SEQ ID NO: 303
  synthetic polypeptide

SEQ ID NO: 308 - protein, 377 aa, Artificial Sequence; identical to SEQ ID NO: 304
  synthetic polypeptide

SEQ ID NO: 309 - protein, 84 aa, Artificial Sequence; identical to SEQ ID NO: 67
  synthetic polypeptide

SEQ ID NO: 310 - protein, 377 aa, Artificial Sequence
  synthetic polypeptide
FLGFLLGVGSAIASGIAVSKVLHLEGEVNKIKNALLSTNKAVVSLSNGVSVCTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 311 - protein, 84 aa, Artificial Sequence; identical to SEQ ID NO: 67
  synthetic polypeptide

SEQ ID NO: 312 - protein, 377 aa, Artificial Sequence
  synthetic polypeptide
FLGFLLGVGSAIASGIAVSKVLHLEGEVNKIKNALLSTNKAVVSLSNGVSVCTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 313 - protein, 84 aa, Artificial Sequence
  synthetic polypeptide
QNITEEFYQSTCSAVSRGYLSALRTGWYHCVITIELSNIKETKCNGTDTKVKLIKQELDKYKNAVTELQLLMQNTPAANNRARR

SEQ ID NO: 314 - protein, 377 aa, Artificial Sequence
  synthetic polypeptide
FLGFLLGVGSAIASGIAVSKVLHLEGEVNKIKNALLSTNKAVVSLSNGVSVCTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 315 - protein, 84 aa, Artificial Sequence; identical to SEQ ID NO: 303
  synthetic polypeptide

SEQ ID NO: 316 - protein, 377 aa, Artificial Sequence
  synthetic polypeptide
FLGFLLGVGSAIASGIAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 317 - protein, 84 aa, Artificial Sequence; identical to SEQ ID NO: 303
  synthetic polypeptide

SEQ ID NO: 318 - protein, 377 aa, Artificial Sequence; identical to SEQ ID NO: 316
  synthetic polypeptide

SEQ ID NO: 319 - protein, 84 aa, Artificial Sequence; identical to SEQ ID NO: 303
  synthetic polypeptide

SEQ ID NO: 320 - protein, 377 aa, Artificial Sequence; identical to SEQ ID NO: 316
  synthetic polypeptide

SEQ ID NO: 321 - protein, 84 aa, Artificial Sequence; identical to SEQ ID NO: 67
  synthetic polypeptide

SEQ ID NO: 322 - protein, 377 aa, Artificial Sequence
  synthetic polypeptide
FLGFLLGVGSAIASGIAVSKVLHLEGEVNKIKNALLSTNKAVVSLSNGVSVCTIKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 323 - protein, 84 aa, Artificial Sequence; identical to SEQ ID NO: 67
  synthetic polypeptide

SEQ ID NO: 324 - protein, 377 aa, Artificial Sequence
  synthetic polypeptide
FLGFLLGVGSAIASGIAVSKVLHLEGEVNKIKNALLSTNKAVVSLSNGVSVCTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 325 - protein, 84 aa, Artificial Sequence; identical to SEQ ID NO: 313
  synthetic polypeptide

SEQ ID NO: 326 - protein, 377 aa, Artificial Sequence
  synthetic polypeptide
FLGFLLGVGSAIASGIAVSKVLHLEGEVNKIKNALLSTNKAVVSLSNGVSVCTIKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

The invention claimed is:

1. A method of purifying a recombinantly-produced respiratory syncytial virus (RSV) F protein from a sample in trimeric form, sequentially comprising: (a) performing an anion exchange chromatography step on a sample comprising recombinantly-produced RSV F protein and impurities, (b) performing a ceramic hydroxyapatite (cHA) chromatography step in flow-through mode on the eluate from the anion exchange chromatography step, wherein impurities bind to the cHA medium and RSV F protein flows through, producing a flow-through pool enriched in RSV F protein, and (c) performing a hydrophobic interaction chromatography (HIC) step on the flow-through pool from the cHA chromatography step.

2. The method according to claim 1, wherein the anion exchange chromatography step is run in a bind and elute mode and comprises:

(a) contacting a load solution comprising the RSV F protein with an anion exchange chromatography medium, whereby the RSV F protein binds to the anion exchange chromatography medium;

(b) washing the anion exchange chromatography medium with at least one lower pH wash solution at a pH between 3.0 and 6.5; and (c) eluting the RSV F protein from the anion exchange chromatography medium, thereby obtaining an anion exchange elution pool.

3. The method according to claim 2, wherein the pH of the load solution is between 7.0 and 8.5.

4. The method according to claim 2, wherein the pH of said lower pH wash solution is between 4.0 and 6.0.

5. The method according to claim 4, wherein said lower pH wash solution comprises acetate at a concentration between 56 and 84 mM.

6. The method according to claim 5, wherein prior to washing the anion exchange chromatography medium with the lower pH wash solution, the anion exchange chromatography medium is washed with at least a first higher pH wash solution at a pH between 7.0 and 8.0.

7. The method according to claim 6, wherein said first higher pH wash solution comprises Tris at a concentration between 18 and 22 mM.

8. The method according to claim 7, wherein said first higher pH wash solution comprises NaCl at a concentration between 45 and 55 mM.

9. The method according to claim 8, wherein after washing the anion exchange chromatography medium with the lower pH wash solution and prior to eluting the RSV F protein, the anion exchange chromatography medium is further washed with at least a second higher pH wash solution at a pH between 7.0 and 8.0.

10. The method according to claim 9, wherein said second higher pH wash solution comprises Tris at a concentration between 45 and 55 mM.

11. The method according to claim 10, wherein said second higher pH wash solution comprises NaCl at a concentration between 18 and 22 mM.

12. The method according to claim 11, wherein the RSV F protein is eluted with an elution solution having a pH between 7.0 and 8.0.

13. The method according to claim 12, wherein said elution solution comprises NaCl at a concentration between 146 and 180 mM.

14. The method according to claim 13, wherein said elution solution comprises Tris at a concentration between 18 and 22 mM.

15. The method claim 1, wherein the cHA chromatography step is run in a flow-through mode and comprises:

(a) adding phosphate to the anion exchange elution pool, thereby obtaining a cHA load solution;

(b) contacting said cHA load solution, comprising the RSV F protein and impurities, with a cHA medium, whereby impurities bind to the medium while the RSV F protein flows through the medium;

(c) washing the cHA chromatography medium with a cHA wash solution at a pH between 6.0 and 8.0; and (d) collecting the RSV F protein in a flow-through pool.

16. The method according to claim 15, wherein the cHA wash solution comprises Tris at a concentration of about 20 mM, NaCl at a concentration of about 100 mM and sodium phosphate at a concentration of about 13 mM.

17. The method according to claim 1, wherein the HIC step is run in a bind and elute mode and comprises:

(a) adding phosphate to the flow-through pool from the cHA chromatography step, thereby obtaining a HIC load solution;

(b) contacting said HIC load solution, comprising the RSV F protein, with a HIC medium, whereby the RSV F protein binds to the HIC medium;

(c) washing the HIC medium with a HIC wash solution at a pH between 6.0 and 8.0; and (d) eluting the RSV F protein from the HIC medium with a HIC elution solution at a pH between 6.0 and 8.0.

18. The method according to claim 17, wherein the HIC wash solution comprises potassium phosphate at a concentration of about 1.1 M.

19. The method according to claim 18, wherein the HIC elution solution comprises potassium phosphate at a concentration of about 448 mM.

20. The method according to claim 1, wherein the RSV F protein is a protein from RSV subgroup A.

21. The method according to claim 1, wherein the RSV F protein is a protein from RSV subgroup B.

22. The method according to claim 1, wherein the RSV F protein is in a prefusion conformation.

23. The method according to claim 1, wherein the RSV F protein is a mutant of a wild-type F protein for any RSV subgroup that contains one or more introduced mutations.

24. The method according to claim 23, wherein the RSV F mutant is stabilized in prefusion conformation.

25. The method according to claim 24, wherein the RSV F mutant specifically binds to antibody D25 or AM14.

26. The method according to claim 1, wherein the RSV F protein is formulated for use as an injectable pharmaceutical product.

27. A method of purifying a recombinantly-produced respiratory syncytial virus (RSV) F protein from a sample comprising:

(a) performing an anion-exchange (AEX) chromatography step by:

(i) contacting said sample with an AEX chromatography medium, wherein RSV F protein binds to the medium, (ii) washing the AEX chromatography medium with an AEX wash solution; and (iii) eluting RSV F protein from the AEX chromatography medium, producing an AEX elution pool, (b) performing a ceramic hydroxyapatite (cHA) chromatography step in flow-through mode by:

(iv) adding phosphate to said AEX elution pool, producing a cHA load solution, (v) contacting the cHA load solution with a cHA medium, wherein impurities present in the cHA load solution bind to the medium and RSV F protein flows through, producing a flow-through pool enriched in RSV F protein; and (c) performing a hydrophobic interaction chromatography (HIC) step by:

(vi) adding phosphate to the flow-through pool, producing a HIC load solution, (vii) contacting the HIC load solution with a HIC medium, wherein RSV F protein present in the HIC load solution binds to the HIC medium, (viii) washing the HIC medium with a HIC wash solution; and (ix) eluting RSV F protein from the HIC medium with a HIC elution solution.

28. The method of claim 27, wherein either or both of said AEX chromatography step and said HIC step is run in a bind and elute mode.

29. The method of claim 27, wherein said AEX wash solution comprises acetate, citrate, phosphate, sulfate, or chloride.

30. The method of claim 29, wherein said AEX wash solution comprises acetate.

31. The method of claim 27, wherein said AEX wash solution has a pH between 3.0 and 6.5.

32. The method of claim 27, wherein said cHA chromatography step further comprises, after said step of contacting, washing the cHA chromatography medium with a cHA wash solution.

33. The method of claim 32, wherein said cHA wash solution has a pH between 6.0 and 8.0.

34. The method of claim 27, wherein either or both of said HIC wash solution and said HIC elution solution has a pH between 6.0 and 8.0.

35. The method of claim 27, wherein said method is effective to purify RSV trimers in prefusion conformation.

* * * * *